United States Patent 11,446,398 (REGULATED BIOCIRCUIT SYSTEMS) - sequence listing, part 47

SEQ ID NO: 137163 - DNA, 4584 bp, Homo sapiens
  Payload ID: 6853
  Gene Symbol: GLDN
  Gene Name: gliomedin
  Uniprot ID: Q6ZMI3
  ENST ID: ENST00000396399
  CDS Start-End: 50-1333
accattgtgtatgattcgttgttgactgcagcatcactagatccgagtgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatggggatacctggagctgcaggaaatccaggggaaaggggagaaaagggagaccatggtgaactgggcctgcagggaaatgagggcccaccagggcagaagggagaaaagggtgacaaaggagatgtgtccaacgacgtgctcctggcaggtgccaaaggtgaccaaggcccacccggtccacctgggcccccaggccctccaggtcctccagggccccctggaagcagaagagccaaaggccctcggcagccaagcatgttcaacggccagtgcccaggtgagacttgtgccataccaaatgatgataccttggttggaaaagctgatgagaaagccagtgaacaccattccccacaagcagaatccatgatcacttccattggaaacccagtgcaagtactgaaagtgacagagacatttgggacttggataagagagtctgctaacaagagtgatgaccggatttgggtgacagagcatttttcaggcatcatggttaaggaattcaaggatcagccctcacttctgaatggcagttacacgttcatccaccttccatactatttccatggctgtgggcacgttgtttacaacaactctctctactaccacaaagggggttctaataccctagtgagatttgaatttggccaggaaacatcccaaactctgaagcttgaaaatgccttgtattttgatcgaaaatacctttttgcaaattccaaaacttacttcaatctagctgtagatgaaaagggcctttggattatctatgcgtcaagtgtggacggctcgagcattcttgtagcacaactggatgagaggacattctcagtggtgcaacacgtcaataccacgtaccctaaatccaaggctggcaacgccttcattgcccgaggaatcctctatgtcacagacaccaaagatatgagggtcacatttgcctttgatttgttaggagggaaacagatcaatgcaaactttgatttaagaacttcccagtctgttcttgccatgttagcatacaacatgagagatcagcatttatattcatgggaagatggccatttaatgctttatcctgtgcagtttttgtcaactaccttaaatcagtgatgtgctgcattcggctcccttcagcaaatttcaggggttttctgggaccagttctcccccaacaggaaacttgtttttttaacgtcagccagatatttagaaaataacctcaaaagtgtttatatggtcagtgagccccgcttagtgaaatagcaacagattggaagttgaaatggctgagatttggtgatctccccacagctggctctgcaagttacctctttctccttgggccttagtttccccattggtaatctgaattggctaagatgattggggagattttctgtacctgtaggtaatttggtgattcttggtggctgctcttctcacaacttttatgtatctgcttctgtcgtttagcttttttagccacatgctgaccaaatttacctttgagttgataagtccagtggcttgagtagtgaatccctcagtgctgacttatatcttgttctttgaaaaaatgcattgactctttaagacatctaaagtatcacattatccataatttattgcttttctttgcatctgcacctgccaccacagaataaccattaccctcagctgctgattgggcagctctgagattagcaaaagccagggacagctacatgttcaggtttttttttttttttttttttcaataagctattttttttcttttcttattttaaatagagagagagtcttgctatgtttcccaggctggtcttgaactcctggggctcaagtgatcctcctgccttggcctcccaaaatgctggattacaggcatgtgtgcctggcccaggtttcttaataaaacagaatcatgatcttccaggttccccccagtttctgatcatgttgatttgtagctgtggatcatgaacactgaatcctcagatcactctgacttcttatgcttctcctgtggatccactatcaaagtactaaatgctgtgtaagtagacgttaatctggctggaaccatgggaagcactttgcagtgttcagaagagaggctccatttgtggctattatgtagaactgggccagagccagtccattgcctgtttttttaaataaggttttactgagcacagccacactcatttgtttatgcagtacggcctgacattgcttttgctctgcaacagcagagtcgagtcattgcaacaaagagcatatggccccacagtgcctaaaatattgaccagctacccctttatggaaaaagattgctgactcctgataaagaatataaagtgagcctgattcttgaaaaaatcagaaccagagcctgttttgttttgttctaaactaagaagccgcataggatgtgacttgcgttttgagtagaggggaaggctgataacggcgtaagatgaagtggccctccacaaaggctggttaggggacagttctttctctaacatagttttaaaggatgtgatctggtccccttggatgccaggagagaatccagttgaacttgctcctaaatgctcttaaatatgcatattttctgccaactcacttctttaaacatctttcagcccagcgctgcggccccgggaagggccactgcgaatagagaggaagctggaaaagttcctggggctctgcagccaggaaggggaaccagggcaaatcttatgtaaagatttttcagcaacttgtcccaatttgtgtgtattctgaaactttctctttgggaccaaattcattctcaatggccctgagttcaatatattattaacagcagtattttaaaacttagggttgaactgggcatggtggcacataactgcaatcccagctactttggaggcagggatgggaggatcacttgaggccaggatctcaggaccagcctagagagatcccatctctaaaaaataaaatataagaaaataaaacttaggggatatacagatttaaatattcaaatctccctgctcccctgaaagtccccaggcagctgtcaatgacttgtttgttgtgttctcaatatgatggctatttgaaacttcacctacttttcattagattggttgtaccatgtcaccttagcttttaaaaatactcttttcagattcacgttctctaacaaagagtctcatgttcaagatcaatatgtctaataagtgctggtgtccttttaaagtatttaaatatatatgttgctgttgctgaatacaggagaccaggttaggaatatagtttcataataatagtacatacaatactaattgtatataaggtagcaaccaaaagaggttgttaattagcacatattccttttagaaaaatgtttcagaaacctcagtcttgatatctgagctatctgggctcccttacttgtgagtaagggatcatgctcaccactggagaagcttacaccgggactttttttcttttttcttttttttttgctatgacagagtaatgctaacgtaaggacaactgagtttgatcagtgtttaatcgcagtgggtaatcttatctgattgtctttaaaagtgaaaaggattaagattttattctttcttgtaaacattacttgattttttaaagaagttttgggctcactgctaaaatagagtatacaactgaatgtttttaagtcaagatactgttttaggagtttaccctctcatttataaccaaagttgctctaaaacactttccaaatatctgcacttctgatgtcagaatcaaaccagataattctctaattcttctttaatctaaagtagatagcttcccactggaaagtaaacaaaaccatccctcccaacctcaaagctaggccacactctatttcaaggcattttctttcagctgataaggtgtcctcctgaagccaagtaggtggttctggtctccaagtatcgttaagcacaggtgctatgacagaaaaagttctggggtggaagttttaagatgaggagttctgatcttaggcatcttaacagtcacaaggtgaaaagtcaaatgaaacagtacaattcttgatgagtgaggtgtcatcttccaaccacacagaggacgttttggctatgatcatctgatggcaagtgaaggagaaatgagtgatagggctttgcgttttcatccagatgctgtggccctgtgtttcacagcattaagagccataatttccaacctgcacagatcctgaacaacaaatgaataacgatgaatgtctttttggttgtaatttaacaagtcaaataaaataatcattgctgagcacaatcaca

SEQ ID NO: 137164 - DNA, 571 bp, Homo sapiens
  Payload ID: 6853
  Gene Symbol: GLDN
  Gene Name: gliomedin
  ENST ID: ENST00000558426
  CDS Start-End: 77-571
ggtgactttttatgattgctttctgctcgtctgaataaaggatgagcccagggcctgctgcccactgtctgctctgatgaccctctctcccctgcagatccgagtgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatggggatacctggagctgcaggaaatccaggggaaaggggagaaaagggagaccatggtgaactgggcctgcagggaaatgagggcccaccagggcagaagggagaaaagggtgacaaaggagatgtgtccaacgacgtgctcctggcaggtgccaaaggtgaccaaggcccacccggtccacctgggcccccaggccctccaggtcctccagggccccctggaagcagaagagccaaaggccctcggcagccaagcatgttcaacggccagtgcccaggtgagacttgtgccatacca

SEQ ID NO: 137165 - DNA, 1676 bp, Homo sapiens
  Payload ID: 6853
  Gene Symbol: GLDN
  Gene Name: gliomedin
  Uniprot ID: Q6ZMI3
  ENST ID: ENST00000612989
  CDS Start-End: 3-1286
tgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatggggatacctggagctgcaggaaatccaggggaaaggggagaaaagggagaccatggtgaactgggcctgcagggaaatgagggcccaccagggcagaagggagaaaagggtgacaaaggagatgtgtccaacgacgtgctcctggcaggtgccaaaggtgaccaaggcccacccggtccacctgggcccccaggccctccaggtcctccagggccccctggaagcagaagagccaaaggccctcggcagccaagcatgttcaacggccagtgcccaggtgagacttgtgccataccaaatgatgataccttggttggaaaagctgatgagaaagccagtgaacaccattccccacaagcagaatccatgatcacttccattggaaacccagtgcaagtactgaaagtgacagagacatttgggacttggataagagagtctgctaacaagagtgatgaccggatttgggtgacagagcatttttcaggcatcatggttaaggaattcaaggatcagccctcacttctgaatggcagttacacgttcatccaccttccatactatttccatggctgtgggcacgttgtttacaacaactctctctactaccacaaagggggttctaataccctagtgagatttgaatttggccaggaaacatcccaaactctgaagcttgaaaatgccttgtattttgatcgaaaatacctttttgcaaattccaaaacttacttcaatctagctgtagatgaaaagggcctttggattatctatgcgtcaagtgtggacggctcgagcattcttgtagcacaactggatgagaggacattctcagtggtgcaacacgtcaataccacgtaccctaaatccaaggctggcaacgccttcattgcccgaggaatcctctatgtcacagacaccaaagatatgagggtcacatttgcctttgatttgttaggagggaaacagatcaatgcaaactttgatttaagaacttcccagtctgttcttgccatgttagcatacaacatgagagatcagcatttatattcatgggaagatggccatttaatgctttatcctgtgcagtttttgtcaactaccttaaatcagtgatgtgctgcattcggctcccttcagcaaatttcaggggttttctgggaccagttctcccccaacaggaaacttgtttttttaacgtcagccagatatttagaaaataacctcaaaagtgtttatatggtcagtgagccccgcttagtgaaatagcaacagattggaagttgaaatggctgagattttctgtacctgtaggtaatttggtgattcttggtggctgctcttctcacaacttttatgtatctgcttctgtcgtttagcttttttagccacatgctgaccaaatttacctttgagttgataagtccagtggcttgagtagtgaatccctcagtgctgacttatatcttgttctttgaaaaaatgcattgactctttaagacatct

SEQ ID NO: 137166 - DNA, 2088 bp, Homo sapiens
  Payload ID: 6853
  Gene Symbol: GLDN
  Gene Name: gliomedin
  ENST ID: ENST00000560215
  CDS Start-End: 1-454
gtgccagtggcgcgggctgagctcggcgctgcgggctttggaggcgcagcggggccgggagcagcgcgaggacagtgccctgcgctccttcctggccgagttgagccgcgcgccgcgcggggcgtccgcaccaccccaagacccggccagctcagctcgcaacaagcgcagccacagcggcgagcccgcgccgcatatccgcgccgagagccatgacatgctgatgatgatgacctactccatggtgccgatccgagtgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatgggtatttttggcaactcttctaattaatttccctgttatttatctccatgattgcatttgggtcgactaaaactgtgtgcagcaggggtaaggtgtttcatctctgcacagtttaaggccggtttaactcttacctagaagccattgcgttccgggataccaagggtatacttcttggtcccaccttgacagatgtttatttcaaactggagaagccgtctcctgggaactgactcgcacccttctgctgcagatgggaggtggaaggagcaggagcccacagccctgggaggggcattctgtgggccgtgtgacagctggtgctggtgcatgctctttcgaggctcagctcctgccttgccctctattgcctcctcctgcccagcgaatctgtgtttggttgaaaatcaatgaactgatgttggcccctggtaaggcatttcttggctagaggaatagctcaaactgcttgagtggaaaggcagcatcctggcctccctgtggccggcactcaggtcaaagggtctcctcttcaggggctacaggataactatgaagatatggctggcatctcggaggagcttcctttgccctgttatgagcaggccatcaccactggagaaaaggcccagaagcaccaaggcacgagatgtgcccagggagcagtaagaatcaggggctggtgcagggcctggcaggaggctggggcacaaaggggaagattctgaagggctctgagcaccagtcctggggagccggggtcagggcagatccacctgaagaaagctggcacatgctgtggtgggagctcaaagacagagggtaagaaactactcaggaggctcctacgaaggcctggctctcagccacccgtcaaagccactgctgagggcagagggaggttgttttcagccggagactccactgcaccatcttattttcaacctcttggctctgctacccaaactcacttggactggccctggacgagaagaaatggtagaaaattcttccagacagcaattactcctttggtcacctccactcttattctcattagcaattgaagtaagggccagtggagagggaaaaattgtcgagcacctctgacacttggcagtgcctacctgcttgtgttccagagggcagcttcagagaaaacgggcacacaccgtccaagccagctcaatcctcagaaggccagtaattaccattggaattacacagcagcaatggatcgttcatataggataataattataattatacatgagcatcgctgtagaataatgatgcctattggcttatcctgggaagactccaaaaatgtgattcagtcctgaggcctcggcaatgggcatgatgagggcaggctcaggggcaggagggcaccctgctagagctgggtgtggggcacgtaggaaaggggtggttttcaaaaaggcttgagacagatccctggccttgaggatgtgcttcgcatgcagcctgcaacccagggagtgcagaaaagaaaaagtgcatttgtttatggagcacatatttgtgtggcaggtaccattctagatgctggagattcagaaataagcccccctcctccaccttcacgaggcttacatcctagctgggagagacggataataaataagataaataaatag

SEQ ID NO: 137167 - DNA, 2812 bp, Homo sapiens
  Payload ID: 6854
  Gene Symbol: GLIS1
  Gene Name: GLIS family zinc finger 1
  Uniprot ID: Q8NBF1
  ENST ID: ENST00000312233
  CDS Start-End: 568-2430
cactgtgtactgagactggatgcatccttgcaataaaaaagaggttgatcacgacaaatgtgaaccccgccgttataaaaacagccatcatggctgtaaatgccaaaaagcagtcagtcttgtaacttgaaaaaaaaaaaaaaggaattgtagattgtgcgcatggactcggagtgggggcggtggacagtaagtcatgatgttttggtggtaccacctggttgaatttcttcatctgaataagaagctcctgtgatgttctggggaggccttggaaggctagcgcatccctcatagaaagtgaatgggagctacggacaccgtaccccgggctcagagaagagcctgctggacctggaccttgctgagggccctggccccacctgctgccagggcctgtttctccctgcaggaagcccaccgccccgggctcacccccaagcttgtgagaggctgctgcatttcccccaccctgacaggtcacctagaccccaggccacgtatgtgaacggcagcctcccaaccacacaacacatcaaacaggagtccttgcccgactaccaagccatggcagaggcccgcacatccctgtctgcccactgtcggggcccgctggccactggcctgcacccagacctggacctcccgggccgaagcctcgccacccctgcgccttcctgctaccttctgggcagcgaacccagctctggcctgggcctccagcccgagacccacctccccgagggcagcctgaagcggtgctgcgtcttgggcctaccccccacctccccagcctcctcctcaccctgtgcctcctccgacgtcacctccatcatccgctcctcccagacgtctctggtcacctgtgtaaatggactccggagcccccctctgacgggagatctggggggcccttccaagcgggcccggcctggccctgcatcgacggacagccatgagggcagcttgcaacttgaagcctgccggaaggcgagcttcctgaagcaggaacccgcggatgagttttcagagctctttgggcctcaccagcagggcctgccgcccccctatcccctgtctcagttgccgcctggcccaagccttggaggcctggggctgggcctggcaggcagggtggtggccgggcggcaggcgtgccgctgggtggactgctgtgcagcctatgagcagcaggaggagctggtgcggcacatcgagaagagccacatcgaccagcgcaagggcgaggacttcacctgcttctgggctggctgcgtgcgccgctacaagcccttcaacgcccgctacaagctgctcatccacatgcgagtgcactcgggcgagaagcccaacaagtgcatgtttgaaggctgcagcaaggccttctcacggctggagaacctcaagatccacctgaggagccacacgggcgagaagccgtacctgtgccagcacccgggttgccagaaggccttcagcaactccagcgaccgcgccaagcaccagcgcacccacctagacacgaagccgtacgcctgtcagatccctggctgctccaagcgctacacagaccccagctccctccgcaagcacgtcaaggcccattcagccaaagagcagcaggtgcgtaagaagctgcatgcgggccctgacaccgaggccgacgtcctgaccgagtgtctggtcctgcagcagctccacacgtccacacagctggctgccagcgacggcaagggtggctgtggcctgggccaggagctgctcccaggtgtgtatcctggctccatcaccccccataacggacttgcatcgggcctcctgcccccagcgcacgacgtaccttccaggcaccacccgctggatgccaccaccagttcccaccaccatctgtcccctctgcccatggctgagagcacccgggatgggttggggcccggcctcctctcaccaatagtcagccccctgaaggggctggggccaccgccgctgcccccatcctctcagagccattctccggggggccagcccttccccacactccccagcaagccgtcctacccacccttccagagccctccacccccgcctctgcccagcccacaaggttaccagggcagtttccactccatccagagttgcttcccctatggcgactgctaccggatggctgaaccagcagccggtggggacggactggtcggggagacccacggtttcaaccccctgcggcccaatggctaccacagcctcagcacgcccttgcctgccacaggctatgaggccctggctgaggcctcatgccccacagcgctgccacagcagccatctgaagatgtggtgtccagcggccccgaggactgtggcttcttccccaatggagcctttgaccactgcctgggccacatcccctccatctacacagacacctgaaggagcccccacatgcgcctgcccatccagcactgcagatgccacctcgcccacctgctgtcgctcccaccctccgtgcacctagcaggagtgccaggccacagccggaacagccaggccatgacccaggggagccagcgctgccaccccacccagcgctgccagggagccgccatccgagcttgagctgggcgcacagaggtgcccgccaggatctgtggccctgtaacattccctcgatcttgtcttcccgttcctccccgcagtggttttgaaatcacagacctcgtgtatataaaatatgcagaacttgttttccgttcccctgccagttttatatttttggttttacaagaaaaaacattaaaaactggaaaggaga

SEQ ID NO: 137168 - DNA, 2807 bp, Homo sapiens
  Payload ID: 6854
  Gene Symbol: GLIS1
  Gene Name: GLIS family zinc finger 1
  ENST ID: ENST00000628545
  CDS Start-End: 43-2430
gagcccggcgcgacccccagccgtgcgccccgccccggcgccatgcattgcgaggtggctgaggcacactcggacaagaggcctaaggaggcccctggtgcgcccggccccgaccgcggccccgccagcctcggcgcgcacatggccttcagggtcaccgtgagtggcggcggctgcggggacaggggcccgcgggacctgctagcccggccgcctgcgccgccaccgcgcgcccacgacctcctccggccccgcagtccccgagactacggtccatccaaggccgccgccgccgggaaggtgaatgggagctacggacaccgtaccccgggctcagagaagagcctgctggacctggaccttgctgagggccctggccccacctgctgccagggcctgtttctccctgcaggaagcccaccgccccgggctcacccccaagcttgtgagaggctgctgcatttcccccaccctgacaggtcacctagaccccaggccacgtatgtgaacggcagcctcccaaccacacaacacatcaaacaggagtccttgcccgactaccaagccatggcagaggcccgcacatccctgtctgcccactgtcggggcccgctggccactggcctgcacccagacctggacctcccgggccgaagcctcgccacccctgcgccttcctgctaccttctgggcagcgaacccagctctggcctgggcctccagcccgagacccacctccccgagggcagcctgaagcggtgctgcgtcttgggcctaccccccacctccccagcctcctcctcaccctgtgcctcctccgacgtcacctccatcatccgctcctcccagacgtctctggtcacctgtgtaaatggactccggagcccccctctgacgggagatctggggggcccttccaagcgggcccggcctggccctgcatcgacggacagccatgagggcagcttgcaacttgaagcctgccggaaggcgagcttcctgaagcaggaacccgcggatgagttttcagagctctttgggcctcaccagcagggcctgccgcccccctatcccctgtctcagttgccgcctggcccaagccttggaggcctggggctgggcctggcaggcagggtggtggccgggcggcaggcgtgccgctgggtggactgctgtgcagcctatgagcagcaggaggagctggtgcggcacatcgagaagagccacatcgaccagcgcaagggcgaggacttcacctgcttctgggctggctgcgtgcgccgctacaagcccttcaacgcccgctacaagctgctcatccacatgcgagtgcactcgggcgagaagcccaacaagtgcatgtttgaaggctgcagcaaggccttctcacggctggagaacctcaagatccacctgaggagccacacgggcgagaagccgtacctgtgccagcacccgggttgccagaaggccttcagcaactccagcgaccgcgccaagcaccagcgcacccacctagacacgaagccgtacgcctgtcagatccctggctgctccaagcgctacacagaccccagctccctccgcaagcacgtcaaggcccattcagccaaagagcagcaggtgcgtaagaagctgcatgcgggccctgacaccgaggccgacgtcctgaccgagtgtctggtcctgcagcagctccacacgtccacacagctggctgccagcgacggcaagggtggctgtggcctgggccaggagctgctcccaggtgtgtatcctggctccatcaccccccataacggacttgcatcgggcctcctgcccccagcgcacgacgtaccttccaggcaccacccgctggatgccaccaccagttcccaccaccatctgtcccctctgcccatggctgagagcacccgggatgggttggggcccggcctcctctcaccaatagtcagccccctgaaggggctggggccaccgccgctgcccccatcctctcagagccattctccggggggccagcccttccccacactccccagcaagccgtcctacccacccttccagagccctccacccccgcctctgcccagcccacaaggttaccagggcagtttccactccatccagagttgcttcccctatggcgactgctaccggatggctgaaccagcagccggtggggacggactggtcggggagacccacggtttcaaccccctgcggcccaatggctaccacagcctcagcacgcccttgcctgccacaggctatgaggccctggctgaggcctcatgccccacagcgctgccacagcagccatctgaagatgtggtgtccagcggccccgaggactgtggcttcttccccaatggagcctttgaccactgcctgggccacatcccctccatctacacagacacctgaaggagcccccacatgcgcctgcccatccagcactgcagatgccacctcgcccacctgctgtcgctcccaccctccgtgcacctagcaggagtgccaggccacagccggaacagccaggccatgacccaggggagccagcgctgccaccccacccagcgctgccagggagccgccatccgagcttgagctgggcgcacagaggtgcccgccaggatctgtggccctgtaacattccctcgatcttgtcttcccgttcctccccgcagtggttttgaaatcacagacctcgtgtatataaaatatgcagaacttgttttccgttcccctgccagttttatatttttggttttacaagaaaaaacattaaaaactggaaa

SEQ ID NO: 137169 - DNA, 4469 bp, Homo sapiens
  Payload ID: 6855
  Gene Symbol: GLIS2
  Gene Name: GLIS family zinc finger 2
  Uniprot ID: Q9BZE0
  ENST ID: ENST00000262366
  CDS Start-End: 822-2396
agatgcctcacctctaggggatgctgattctgggatgcctttttcgtctcctaggctcctcaaggccaactgcgctgggaagagggggtgtccaacagcaggagggctgtttttttgaactacaatttgccagcatacagcagagcagcaagaagataacagggcggggggcacgggattagcccaaacaaaacacactcaagaacgcgagtctgtggttcaacacgaggcagaaaacagctgggccgggtgcggggcttctccctcgcgtgtatccgctcactgcactcgctgccctggccgcgggcgccgcgcagggtgctgatgtccaggagggatctagacctcccgcggcgctcgggctagtggacgcaggtggtcccaaatgctgggaccaagctaggaaccaagcggaagctcggattgctcggcatcgggcctcgtcgttattctaccgtgagggaaactgagaccgagggcacggcagggagtcgcccgccgtctcaccagcgtgaggggttgcgccgggccccgaaaactggtttgcgccgcccggcatcgggatccgggacctctgcccgccgggcgctgcctgcgcgttcctggaactgggctgggcggagaaatcagggcccgcagagaggcattcctgccgccttccccgccgcccggggccgcaggggggcctggccaaggcttccagcacagaggagcttcggggaggctggattgcgcctgtgtctaaaaataaacaggttcctgcgtgaagaccagctgggagcccactgcctgctgccacctccaactccggccccctcaccatgcactccctggacgagccgctcgacctgaagctgagtatcaccaagctccgggcggcaagagagaagcgggagaggacgctgggtgtggtccggccccgtgctctgcacagggagctgggcctggtggatgacagccccacacctggctctccaggctccccgccctcaggcttcctgctgaactccaagttccccgagaaggtggagggacgcttttcagcagcccctctcgtggacctcagcctgtcaccaccatctgggctggactcccccaatggcagcagctcgctgtcccccgagcgccagggcaacggggacctgcctccagtgcccagtgcctcggacttccagccactgcgctatttggatggtgtccccagctccttccagttcttcctgcccctcggctccgggggggccctgcacctgcctgcctcctccttccttacccctcccaaggacaagtgcctctcgccagacctgcccctgcccaagcagctggtgtgtcgctgggccaagtgtaaccagctctttgagctcctgcaagacctggtggaccatgtcaacgattaccatgtcaagcccgagaaggatgcggggtactgctgccactgggagggctgcgcccgccatggccgaggtttcaacgccaggtacaagatgctcatccacatccgcacacacaccaacgagaagccacaccgctgtccgacctgcagcaagagcttctcccgcctggagaacctgaagatccacaaccggtcgcacacaggtgagaagccctacgtctgcccctacgagggctgcaacaagcgctattccaactccagtgaccgctttaagcacacgcgcacccactatgtggacaagccctactactgcaagatgcccggctgccacaagcgctacacggaccccagctcactgcgcaagcacatcaaggcccatggccactttgtgtcccacgagcagcaagagctcctgcagctgcgcccaccccccaagccgccactgcccgcccccgacggcggcccctatgtcagtggggcccagatcatcatccccaacccagctgccctctttggaggccctggcctgcccggcttacccctacccctggcccccggcccccttgacctcagtgccctggcctgtggcaacggtgggggcagtgggggtggggggggcatgggccctgggctgccaggccccgtcctgcctctcaatctggccaagaacccgctgctgccctcgccctttggggctggcggactgggcttgcctgtggtctccctccttgctggcgcagctggtggcaaggccgagggggagaaggggcgtgggtcggtgcccaccagggccctgggcatggagggccacaagacgccccttgaaaggacggagagcagctgctcccggccaagccccgatggactccccctgctgccaggcaccgtgctggacctgtccacgggcgtcaactcagctgccagcagcccagaggcgttggcccctggctgggtggtcatcccgccgggctcggtgctgctcaaaccggctgtggtgaactgagcccatcctgcggacagttgtggtgcccccccggcagctcccggcactgcccccgacgaacggaaactcttctgtgaaatagcaataatgtcctactgcccgggcagccccagcccagcccgccgggagcaaggatggtgctaggtcattcatggctggcctcccagcccccgggtggggacctggcctgtcatgcagggagagctgtgctcctgggtgctgaagcctcgctcctgtctgtcccccaccacctggccctcagcttctgagaggctttcccctgcccgacctcctcccgtttccctctcccaccctggcacctccctcacctagtgaccacccatggcaagttgccctctcccagcagagggggtgggtggggtggcatctgccctccctgctagcaccaggctcccccttcctgagaggagcccccagggaccagaggcctgcccttccctcctaggcttacccagcccctgccctgggggctccttggacccctttccctctgaccctgcctccagagggaaagcaagacagatgcaggcccctgcaaagccccaggtagaagcatgccccccaggacaaggcgcctcccactagttaggaggaggcccgctctgcagccgccgtcctcaccccaggccaggcctgcagtaccagacgggatagctggccactccacccctgcaccccagggtctcctccctctaccttttggggcaccctgggagcgtgggaagcaggtccgagggcccctgagctggcaaggggaggtgccaggccagctgtggtgccaagatactgagtgacctgggccctggctcagggagcatgtggggccaggcccagcgccccgtcttcctccttctacccccgctgggcctggcctgggcagcgccccctgcagaggcctttgggtccttggtcctgtaacaggaagggggaggctggctggggacgaccgaccacaggctgggacacagctcctggtctgggggctccaagtgacagcatgcaggggagggggctcccagtcagtgctgtgttgggagctttctggaggctgtggactgaaggccttgagggaagcagtggctggaggagggtgctggacccatgacacgttgcttcctctggcttttccctgctgggccgctttctcagaggcacttccccacccctaacacccagtgggcccccccaggttctgtgccactcagagggaccctggcaggggccagaaccacttaagggtggtgctggagggccttgtgccccagtcccatcccaggacgccctgagggatggacgcagccatgcaccccccatctggggcctctccctgctccctctcccacctggcagctgggagttctggcttctaggcctgccctgtcaccaggcctctgagtggccaggcccttccacctccccatctgtaaaacgaggcagctgcccggacagccttggggtccttagtggccctgcaggtcctctggcagctctgctgaccccaccctctcccggactgcccttctgtcccagaggggtcaccctgacccggcccaccttgccactgggctttggactccagccctgacagggcccagccacactggctctgcccctcgaaggggctatgagcaaggtaggagggagctggtctcctttcttcgggccccacccaggccctgagcaccccccacccctgtgagggccccaggccttaagtccctggcggggtcatgggtttgcgacttgagcagagcggaggaacagggcactggaaggccgacgagctcagcatgcgactcggtgacggaccaggctcggcagggccggtgtactttttgtggttgtcattggtgtgttgttgcacattccaggacgtcagtattttaacaggttctaagtgcctttctatcgtagcttatgttttcctcctcttggctccattgctgttagcatagagttttaaaaaaagagataagctaatgactataacaatatattcctccatgggagaggaagtttataaagaaacaataaaagtgagttgcaaagatg

SEQ ID NO: 137170 - DNA, 3705 bp, Homo sapiens
  Payload ID: 6855
  Gene Symbol: GLIS2
  Gene Name: GLIS family zinc finger 2
  Uniprot ID: Q9BZE0
  ENST ID: ENST00000433375
  CDS Start-End: 58-1632
tgaagaccagctgggagcccactgcctgctgccacctccaactccggccccctcaccatgcactccctggacgagccgctcgacctgaagctgagtatcaccaagctccgggcggcaagagagaagcgggagaggacgctgggtgtggtccggccccgtgctctgcacagggagctgggcctggtggatgacagccccacacctggctctccaggctccccgccctcaggcttcctgctgaactccaagttccccgagaaggtggagggacgcttttcagcagcccctctcgtggacctcagcctgtcaccaccatctgggctggactcccccaatggcagcagctcgctgtcccccgagcgccagggcaacggggacctgcctccagtgcccagtgcctcggacttccagccactgcgctatttggatggtgtccccagctccttccagttcttcctgcccctcggctccgggggggccctgcacctgcctgcctcctccttccttacccctcccaaggacaagtgcctctcgccagacctgcccctgcccaagcagctggtgtgtcgctgggccaagtgtaaccagctctttgagctcctgcaagacctggtggaccatgtcaacgattaccatgtcaagcccgagaaggatgcggggtactgctgccactgggagggctgcgcccgccatggccgaggtttcaacgccaggtacaagatgctcatccacatccgcacacacaccaacgagaagccacaccgctgtccgacctgcagcaagagcttctcccgcctggagaacctgaagatccacaaccggtcgcacacaggtgagaagccctacgtctgcccctacgagggctgcaacaagcgctattccaactccagtgaccgctttaagcacacgcgcacccactatgtggacaagccctactactgcaagatgcccggctgccacaagcgctacacggaccccagctcactgcgcaagcacatcaaggcccatggccactttgtgtcccacgagcagcaagagctcctgcagctgcgcccaccccccaagccgccactgcccgcccccgacggcggcccctatgtcagtggggcccagatcatcatccccaacccagctgccctctttggaggccctggcctgcccggcttacccctacccctggcccccggcccccttgacctcagtgccctggcctgtggcaacggtgggggcagtgggggtggggggggcatgggccctgggctgccaggccccgtcctgcctctcaatctggccaagaacccgctgctgccctcgccctttggggctggcggactgggcttgcctgtggtctccctccttgctggcgcagctggtggcaaggccgagggggagaaggggcgtgggtcggtgcccaccagggccctgggcatggagggccacaagacgccccttgaaaggacggagagcagctgctcccggccaagccccgatggactccccctgctgccaggcaccgtgctggacctgtccacgggcgtcaactcagctgccagcagcccagaggcgttggcccctggctgggtggtcatcccgccgggctcggtgctgctcaaaccggctgtggtgaactgagcccatcctgcggacagttgtggtgcccccccggcagctcccggcactgcccccgacgaacggaaactcttctgtgaaatagcaataatgtcctactgcccgggcagccccagcccagcccgccgggagcaaggatggtgctaggtcattcatggctggcctcccagcccccgggtggggacctggcctgtcatgcagggagagctgtgctcctgggtgctgaagcctcgctcctgtctgtcccccaccacctggccctcagcttctgagaggctttcccctgcccgacctcctcccgtttccctctcccaccctggcacctccctcacctagtgaccacccatggcaagttgccctctcccagcagagggggtgggtggggtggcatctgccctccctgctagcaccaggctcccccttcctgagaggagcccccagggaccagaggcctgcccttccctcctaggcttacccagcccctgccctgggggctccttggacccctttccctctgaccctgcctccagagggaaagcaagacagatgcaggcccctgcaaagccccaggtagaagcatgccccccaggacaaggcgcctcccactagttaggaggaggcccgctctgcagccgccgtcctcaccccaggccaggcctgcagtaccagacgggatagctggccactccacccctgcaccccagggtctcctccctctaccttttggggcaccctgggagcgtgggaagcaggtccgagggcccctgagctggcaaggggaggtgccaggccagctgtggtgccaagatactgagtgacctgggccctggctcagggagcatgtggggccaggcccagcgccccgtcttcctccttctacccccgctgggcctggcctgggcagcgccccctgcagaggcctttgggtccttggtcctgtaacaggaagggggaggctggctggggacgaccgaccacaggctgggacacagctcctggtctgggggctccaagtgacagcatgcaggggagggggctcccagtcagtgctgtgttgggagctttctggaggctgtggactgaaggccttgagggaagcagtggctggaggagggtgctggacccatgacacgttgcttcctctggcttttccctgctgggccgctttctcagaggcacttccccacccctaacacccagtgggcccccccaggttctgtgccactcagagggaccctggcaggggccagaaccacttaagggtggtgctggagggccttgtgccccagtcccatcccaggacgccctgagggatggacgcagccatgcaccccccatctggggcctctccctgctccctctcccacctggcagctgggagttctggcttctaggcctgccctgtcaccaggcctctgagtggccaggcccttccacctccccatctgtaaaacgaggcagctgcccggacagccttggggtccttagtggccctgcaggtcctctggcagctctgctgaccccaccctctcccggactgcccttctgtcccagaggggtcaccctgacccggcccaccttgccactgggctttggactccagccctgacagggcccagccacactggctctgcccctcgaaggggctatgagcaaggtaggagggagctggtctcctttcttcgggccccacccaggccctgagcaccccccacccctgtgagggccccaggccttaagtccctggcggggtcatgggtttgcgacttgagcagagcggaggaacagggcactggaaggccgacgagctcagcatgcgactcggtgacggaccaggctcggcagggccggtgtactttttgtggttgtcattggtgtgttgttgcacattccaggacgtcagtattttaacaggttctaagtgcctttctatcgtagcttatgttttcctcctcttggctccattgctgttagcatagagttttaaaaaaagagataagctaatgactataacaatatattcctccatgggagaggaagtttataaagaaacaataaaagtgagttgcaaagatg

SEQ ID NO: 137171 - DNA, 3705 bp, Homo sapiens
  Payload ID: 6855
  Gene Symbol: GLIS2
  Gene Name: GLIS family zinc finger 2
  Uniprot ID: Q9BZE0
  ENST ID: ENST00000612491
  CDS Start-End: 58-1632
tgaagaccagctgggagcccactgcctgctgccacctccaactccggccccctcaccatgcactccctggacgagccgctcgacctgaagctgagtatcaccaagctccgggcggcaagagagaagcgggagaggacgctgggtgtggtccggccccgtgctctgcacagggagctgggcctggtggatgacagccccacacctggctctccaggctccccgccctcaggcttcctgctgaactccaagttccccgagaaggtggagggacgcttttcagcagcccctctcgtggacctcagcctgtcaccaccatctgggctggactcccccaatggcagcagctcgctgtcccccgagcgccagggcaacggggacctgcctccagtgcccagtgcctcggacttccagccactgcgctatttggatggtgtccccagctccttccagttcttcctgcccctcggctccgggggggccctgcacctgcctgcctcctccttccttacccctcccaaggacaagtgcctctcgccagacctgcccctgcccaagcagctggtgtgtcgctgggccaagtgtaaccagctctttgagctcctgcaagacctggtggaccatgtcaacgattaccatgtcaagcccgagaaggatgcggggtactgctgccactgggagggctgcgcccgccatggccgaggtttcaacgccaggtacaagatgctcatccacatccgcacacacaccaacgagaagccacaccgctgtccgacctgcagcaagagcttctcccgcctggagaacctgaagatccacaaccggtcgcacacaggtgagaagccctacgtctgcccctacgagggctgcaacaagcgctattccaactccagtgaccgctttaagcacacgcgcacccactacgtggacaagccctactactgcaagatgcccggctgccacaagcgctacacggaccccagctcactgcgcaagcacatcaaggcccatggccactttgtgtcccacgagcagcaagagctcctgcagctgcgcccaccccccaagccgccactgcccgcccccgacggcggcccctatgtcagtggggcccagatcatcatccccaacccagctgccctctttggaggccctggcctgcccggcttacccctacccctggcccccggcccccttgacctcagtgccctggcctgtggcaacggtgggggcagtgggggtggggggggcatgggccctgggctgccaggccccgtcctgcctctcaatctggccaagaacccgctgctgccctcgccctttggggctggcggactgggcttgcctgtggtctccctccttgctggcgcagctggtggcaaggccgagggggagaaggggcgtgggtcggtgcccaccagggccctgggcatggagggccacaagacgccccttgaaaggacggagagcagctgctcccggccaagccccgatggactccccctgctgccaggcaccgtgctggacctgtccacgggcgtcaactcagctgccagcagcccagaggcgttggcccctggctgggtggtcatcccgccgggctcggtgctgctcaaaccggctgtggtgaactgagcccatcctgcggacagttgtggtgcccccccggcagctcccggcactgcccccgacgaacggaaactcttctgtgaaatagcaataatgtcctactgcccgggcagccccagcccagcccgccgggagcaaggatggtgctaggtcattcatggctggcctcccagcccccgggtggggacctggcctgtcatgcagggagagctgtgctcctgggtgctgaagcctcgctcctgtctgtcccccaccacctggccctcagcttctgagaggctttcccctgcccgacctcctcccgtttccctctcccaccctggcacctccctcacctagtgaccacccatggcaagttgccctctcccagcagagggggtgggtggggtggcatctgccctccctgctagcaccaggctcccccttcctgagaggagcccccagggaccagaggcctgcccttccctcctaggcttacccagcccctgccctgggggctccttggacccctttccctctgaccctgcctccagagggaaagcaagacagatgcaggcccctgcaaagccccaggtagaagcatgccccccaggacaaggcgcctcccactagttaggagaaggcccgctctgcagccgccgtcctcaccccaggccaggcctgcagtaccagacgggatagctggccactccacccctgcaccccagggtctcctccctctaccttttggggcaccctgggagcgtgggaagcaggtccgagggcccctgagctggcaaggggaggtgccaggccagctgtggtgccaagatactgagtgacctgggccctggctcagggagcatgtggggccaggcccagcgccccgtcttcctccttctacccccgctgggcctggcctgggcagcgccccctgcagaggcctttgggtccttggtcctgtaacaggaagggggaggctggctggggacgaccgaccacaggctgggacacagctcctggtctgggggctccaagtgacagcatgcaggggagggggctcccagtcagtgctgtgttgggagctttctggaggctgtggactgaaggccttgagggaagcagtggctggaggagggtgctggacccatgacacgttgcttcctctggcttttccctgctgggccgctttctcagaggcacttccccacccctaacacccagtgggcccccccaggttctgtgccactcagagggaccctggcaggggccagaaccacttaagggtggtgctggagggccttgtgccccagtcccatcccaggacgccctgagggatggacgcagccatgcaccccccatctggggcctctccctgctccctctcccacctggcagctgggagttctggcttctaggcctgccctgtcaccaggcctctgagtggccaggcccttccacctccccatctgtaaaacgaggcagctgcccggacagccttggggtccttagtggccctgcaggtcctctggcagctctgctgaccccaccctctcccggactgcccttctgtcccagaggggtcaccctgacccggcccaccttgccactgggctttggactccagccctgacagggcccagccacactggctctgcccctcgaaggggctatgagcaaggtaggagggagctggtctcctttcttcgggccccacccaggccctgagcaccccccacccctgtgagggccccaggccttaagtccctggcggggtcatgggtttgcgacttgagcagagcggaggaacagggcactggaaggccgacgagctcagcatgcgactcggtgacggaccaggctcggcagggccggtgtactttttgtggttgtcattggtgtgttgttgcacattccaggacgtcagtattttaacaggttctaagtgcctttctatcgtagcttatgttttcctcctcttggctccattgctgttagcatagagttttaaaaaaagagataagctaatgactataacaatatattcctccatgggagaggaagtttataaagaaacaataaaagtgagttgcaaagatg

SEQ ID NO: 137172 - DNA, 4469 bp, Homo sapiens
  Payload ID: 6855
  Gene Symbol: GLIS2
  Gene Name: GLIS family zinc finger 2
  Uniprot ID: Q9BZE0
  ENST ID: ENST00000633051
  CDS Start-End: 822-2396
agatgcctcacctctaggggatgctgattctgggatgcctttttcgtctcctaggctcctcaaggccaactgcgctgggaagagggggtgtccaacagcaggagggctgtttttttgaactacaatttgccagcatacagcagagcagcaagaagataacagggcggggggcacgggattagcccaaacaaaacacactcaagaacgcgagtctgtggttcaacacgaggcagaaaacagctgggccgggtgcggggcttctccctcgcgtgtatccgctcactgcactcgctgccctggccgcgggcgccgcgcagggtgctgatgtccaggagggatctagacctcccgcggcgctcgggctagtggacgcaggtggtcccaaatgctgggaccaagctaggaaccaagcggaagctcggattgctcggcatcgggcctcgtcgttattctaccgtgagggaaactgagaccgagggcacggcagggagtcgcccgccgtctcaccagcgtgaggggttgcgccgggccccgaaaactggtttgcgccgcccggcatcgggatccgggacctctgcccgccgggcgctgcctgcgcgttcctggaactgggctgggcggagaaatcagggcccgcagagaggcattcctgccgccttccccgccgcccggggccgcaggggggcctggccaaggcttccagcacagaggagcttcggggaggctggattgcgcctgtgtctaaaaataaacaggttcctgcgtgaagaccagctgggagcccactgcctgctgccacctccaactccggccccctcaccatgcactccctggacgagccgctcgacctgaagctgagtatcaccaagctccgggcggcaagagagaagcgggagaggacgctgggtgtggtccggccccgtgctctgcacagggagctgggcctggtggatgacagccccacacctggctctccaggctccccgccctcaggcttcctgctgaactccaagttccccgagaaggtggagggacgcttttcagcagcccctctcgtggacctcagcctgtcaccaccatctgggctggactcccccaatggcagcagctcgctgtcccccgagcgccagggcaacggggacctgcctccagtgcccagtgcctcggacttccagccactgcgctatttggatggtgtccccagctccttccagttcttcctgcccctcggctccgggggggccctgcacctgcctgcctcctccttccttacccctcccaaggacaagtgcctctcgccagacctgcccctgcccaagcagctggtgtgtcgctgggccaagtgtaaccagctctttgagctcctgcaagacctggtggaccatgtcaacgattaccatgtcaagcccgagaaggatgcggggtactgctgccactgggagggctgcgcccgccatggccgaggtttcaacgccaggtacaagatgctcatccacatccgcacacacaccaacgagaagccacaccgctgtccgacctgcagcaagagcttctcccgcctggagaacctgaagatccacaaccggtcgcacacaggtgagaagccctacgtctgcccctacgagggctgcaacaagcgctattccaactccagtgaccgctttaagcacacgcgcacccactacgtggacaagccctactactgcaagatgcccggctgccacaagcgctacacggaccccagctcactgcgcaagcacatcaaggcccatggccactttgtgtcccacgagcagcaagagctcctgcagctgcgcccaccccccaagccgccactgcccgcccccgacggcggcccctatgtcagtggggcccagatcatcatccccaacccagctgccctctttggaggccctggcctgcccggcttacccctacccctggcccccggcccccttgacctcagtgccctggcctgtggcaacggtgggggcagtgggggtggggggggcatgggccctgggctgccaggccccgtcctgcctctcaatctggccaagaacccgctgctgccctcgccctttggggctggcggactgggcttgcctgtggtctccctccttgctggcgcagctggtggcaaggccgagggggagaaggggcgtgggtcggtgcccaccagggccctgggcatggagggccacaagacgccccttgaaaggacggagagcagctgctcccggccaagccccgatggactccccctgctgccaggcaccgtgctggacctgtccacgggcgtcaactcagctgccagcagcccagaggcgttggcccctggctgggtggtcatcccgccgggctcggtgctgctcaaaccggctgtggtgaactgagcccatcctgcggacagttgtggtgcccccccggcagctcccggcactgcccccgacgaacggaaactcttctgtgaaatagcaataatgtcctactgcccgggcagccccagcccagcccgccgggagcaaggatggtgctaggtcattcatggctggcctcccagcccccgggtggggacctggcctgtcatgcagggagagctgtgctcctgggtgctgaagcctcgctcctgtctgtcccccaccacctggccctcagcttctgagaggctttcccctgcccgacctcctcccgtttccctctcccaccctggcacctccctcacctagtgaccacccatggcaagttgccctctcccagcagagggggtgggtggggtggcatctgccctccctgctagcaccaggctcccccttcctgagaggagcccccagggaccagaggcctgcccttccctcctaggcttacccagcccctgccctgggggctccttggacccctttccctctgaccctgcctccagagggaaagcaagacagatgcaggcccctgcaaagccccaggtagaagcatgccccccaggacaaggcgcctcccactagttaggagaaggcccgctctgcagccgccgtcctcaccccaggccaggcctgcagtaccagacgggatagctggccactccacccctgcaccccagggtctcctccctctaccttttggggcaccctgggagcgtgggaagcaggtccgagggcccctgagctggcaaggggaggtgccaggccagctgtggtgccaagatactgagtgacctgggccctggctcagggagcatgtggggccaggcccagcgccccgtcttcctccttctacccccgctgggcctggcctgggcagcgccccctgcagaggcctttgggtccttggtcctgtaacaggaagggggaggctggctggggacgaccgaccacaggctgggacacagctcctggtctgggggctccaagtgacagcatgcaggggagggggctcccagtcagtgctgtgttgggagctttctggaggctgtggactgaaggccttgagggaagcagtggctggaggagggtgctggacccatgacacgttgcttcctctggcttttccctgctgggccgctttctcagaggcacttccccacccctaacacccagtgggcccccccaggttctgtgccactcagagggaccctggcaggggccagaaccacttaagggtggtgctggagggccttgtgccccagtcccatcccaggacgccctgagggatggacgcagccatgcaccccccatctggggcctctccctgctccctctcccacctggcagctgggagttctggcttctaggcctgccctgtcaccaggcctctgagtggccaggcccttccacctccccatctgtaaaacgaggcagctgcccggacagccttggggtccttagtggccctgcaggtcctctggcagctctgctgaccccaccctctcccggactgcccttctgtcccagaggggtcaccctgacccggcccaccttgccactgggctttggactccagccctgacagggcccagccacactggctctgcccctcgaaggggctatgagcaaggtaggagggagctggtctcctttcttcgggccccacccaggccctgagcaccccccacccctgtgagggccccaggccttaagtccctggcggggtcatgggtttgcgacttgagcagagcggaggaacagggcactggaaggccgacgagctcagcatgcgactcggtgacggaccaggctcggcagggccggtgtactttttgtggttgtcattggtgtgttgttgcacattccaggacgtcagtattttaacaggttctaagtgcctttctatcgtagcttatgttttcctcctcttggctccattgctgttagcatagagttttaaaaaaagagataagctaatgactataacaatatattcctccatgggagaggaagtttataaagaaacaataaaagtgagttgcaaagatg

SEQ ID NO: 137173 - DNA, 6667 bp, Homo sapiens
  Payload ID: 6856
  Gene Symbol: GLIS3
  Gene Name: GLIS family zinc finger 3
  Uniprot ID: Q8NEA6
  ENST ID: ENST00000324333
  CDS Start-End: 195-2522
atcctttatggttgaagggtgttggaggaagcagagttttcatcagctgctgaagtggcaactaatagaggtttgaatggccgtagaaaaatattgtgttacttgtttgttgtctaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatggccttgatctaggggatctccttagccttcctcccgggacatccatgtccagcaatagtgtctctaactcattaccatcctacctttttggcacggaaagtagccactctccttaccctagtcctcggcactcatccaccaggtcccactcggcccgctccaagaagagagcgctgtccttgtccccgctgtccgatggcatcgggatagatttcaataccatcatccgcacgtcgcccacgtccttggtggcctacatcaacgggtcgagggcttcgccggccaacctgtccccgcagccggaggtctacgggcatttcctgggcgtgcgcggcagctgcattccccagccgcgcccggtgcccggcagccagaagggcgtgctggtggcccctggaggcctggcgctgccggcctacggcgaggacggggccctggagcacgagcgcatgcaacagctggagcacggcggcctgcagccaggcctggtcaaccacatggtggtgcagcatggcctgccgggccccgacagccagtcggccggcctgttcaagaccgaacgcctggaggagttcccgggcagcaccgtagacctaccccccgcgcctccgctccctcctctgccgccgcccccaggccccccacccccttaccatgcccatgcgcaccttcaccacccggagctcgggccccacgcccagcagctggccttgccccaggccaccctggacgacgacggggagatggacggcatcgggggcaagcattgctgccgctggatcgactgcagcgccctgtacgaccagcaggaggagctcgtgcggcacatcgagaaggtccacatcgaccagcgcaaaggggaggacttcacttgcttctgggccggttgccctcgaagatacaagcccttcaacgcccgctataaactgctgatccacatgagagtccactctggggagaagcccaacaagtgtacgtttgaaggttgcgagaaggccttttcaaggcttgaaaatctcaagatccacttgcggagccacacaggcgagaagccgtatttgtgccagcatccgggttgtcagaaggccttcagtaactccagtgaccgcgccaaacaccagcggacgcatctggacaccaaaccttatgcttgtcaaattccaggatgtaccaaacgctacacagacccaagttccctaagaaagcatgtgaaggcacattcttccaaagagcaacaagcaaggaaaaagttgcggtccagcacagagctccatccagacctgctcacagattgcctcaccgtgcagtccctgcagccggccacttcccctagagatgctgctgctgaagggaccgtgggacgctcccctggacccgggcctgacctctattcagctcccattttctccagcaattattcaagccgaagtggaacagctgctggggccgtaccacccccacatcctgtcagtcacccttctccaggacataatgtacaggggagccctcacaacccctcctcccagttacctccactcacagctgtggacgcaggagctgagaggtttgcaccttctgctccatctcctcaccacatcagcccccggagagttccagctccttcttcaatactgcaaagaacacagcctccctatacccagcagccatcaggttcacacctgaagtcctatcagccagaaacaaactcttcttttcaaccaaatggtatccatgtccatggattttatgggcagctgcagaagttctgtcccccacactaccccgattcccagagaattgtgccgcctgtcagctcctgcagtgtggtgccttcgtttgaggactgcctagtccctacatccatgggccaggccagttttgatgttttccacagagccttctcgactcactcgggcattacagtgtatgatttaccttcaagttcctcgagcctctttggggagtctctccgcagcggggctgaagatgctaccttcttgcagatcagcaccgtggaccgctgtcctagccagctctcctctgtctacaccgaaggctaaaagctctcttggccactcctgcacacccaggaccttgatgttgcttgccaccttttgttttcgtactctcacagactgcttgaggaaggatgtcagcccaatcagcgggccctgcagagttactgatgttctttcagaaggcaggactgaatggcagagctagctttgcaggaatcattacagttgctcctttttctctctggttttcctggactatgtgaccaggaggactgtcttttcaaagggaatttagagcctcactctcctggatacctgttacttcctggctgtcaacccttaaaggaccccagtgaaatgatgtgcatatgaaaatgtagtttggggatgactctacctgaaaactccaaacagggaaaaagacctcaattacgagaggcatagtgacctgcctcacctaatcctcacccttgctgctcctgatgcaaagccaggcacaacaagggaaatccatgtccaaagcatagtgtggtctcaactcttagaaactccctgggtttcccttttctcttagccacatgctaaccagttgcttctcagtgtttctcttcaatagaaaaataaggttttatatgccagcagcctatccttgtttttgcattttaaagacttagttatttatacgtattttaaaatgaaaaaaaaatgtaaaggtctgtgctttggatggaaatcattattattgtaatcaccccagctatagacattttgcacagctgtggttctgcctggccccacctctagcatgttagttttgcagttagcaaaggttacctgagggaaatggagtgggcacctcccgcaccaacagtcctgtagctggaaccttcctgagttgactgtttagtaactccacctcaaagactgtgttcaaagaaaaatgttgtttgactggtttacccattgcctccactctggtgctgcacccagagaagtgccagatgtgagaactgggacagactgagtcatgtgccagcttcccttggaaaaccaaacctagtgatacttgacttccagtgctcagattttactaacgtttttcaggatatccactcatctgtctgtctcttccctacacttctctccaccctctttttgcatccctcttaccctcttcctgactgtggttcatatatccccaccagccgccattgtctgatcatcttgggaaggtagaggtgacagttctcgaaaagtctacagaaagaggcaattctttttctgagttccagtttgaaggcctggaattttcacatagcacttggtcgaaaatatcaagcctaaataggaagtcattttctgtgacacctctacatagctattacagatcctaagtcctagggcatcagctataaaaattggccagtcccaaagacacagtaagttctaacattctggtactatcatatttcaagtattttttctcactttttaaaaatgtttttctgaacaaaagtgaaacaatgccatttatcaaactgagatcattacaatcttcaacaagacaactaaaacagcttgatgttagatgggattctgtgacagtttgtatactgacaggtccttccagtctccctccacagtcccacaagcggaagtattctacctgattccagagttcattccaacatgcagtagaatgaggtgaatgaagaaccaagtgtgggttttgttttcacagtgcacttggtcaatctagtttctctgagtagtgggctgtattctaagaaaagctttcacgtagacgtcaaagtctgcaaaagagatgagttagccactttaaaaaacctgctctgctttacaaaagatgcacaccaggcttcctttacaagtgaactccaaggctgcttgtaaagtaccacccttcctgcagactttgtgggtcgtgtcacttggcctaaacaagtggcctaacatatgcatgctcacagctagtagcatccctcatgcgtcctttgtcatactctggaaagaaaaaaactctgctatcttcagagaaaccatctattcatacttaaatatggaagcctttacaaggaactcaaaatacatttcatttcatttgtacaatgagaaaaaagatgaaaaggcaaggttgttattgcagttgacattgtcagccctgccttttggctttatgtaatttaaaatagaaagggggaaggaggacaagacagaagctcaactttagaaaccatggacatcacctccctctttgagaggagctgcttgtgaaccaggctccagtcttcctgtggcctctcacagtaaccctgcccctttcttacctcacaggggcaagagggactctaaagagggcgtaagcaatagaggcacctgcagccctccttcctcagcaggaaatcaatgtggagccccagagggacattttatctcagagagagcatgctggccacaggacccagtgcagccctgcttcccgcaccgtgggtctttcctgatagctgcaggcttgagattgcagcctcaggataggacacgttcagatgccttccagactacacacactatgcttagattcgagagtctttcctgaccttaaaatttgtcccttgcttactttcacactgcagaagatttatatatatattcatcattatttttgcagcagtacaagtggaaacttcaaaaaaatcattccctttcatgtcctggtctttttaagtcttgatatgtaaccattttcataaatgtccaaacagagattgtcattccccttaaaaacagaaacaaaacacaaaactagtgcttgtgaaaacacacagcgcaaagacaattatcctattgcattaaaaaaaaaatcagtctgcctagagacatttcattggctgcattgtcttaattccctaacgaaactgcatcaaaatgtcagttgtaatttagcctctgatcagctgttaaatattatttaaatatttacaggtcctgtggggtatctcccattacccatgtcgccctcaaattacataagcgatcataaaataagaagaaaaaaaaaggtctttagtagatcacagcagagttaccactgataagagtgttggctttgttcagttgtttctaaattaccagccgtcaagcacagtagcccctaaaaccaattttgagcaaggataaattcaactccctcatctgagaaccttgactttccagttgccttgaagtattgggaatagtaactgtacattttcaatttaattatttggtattttatttgactgtcttggccatgtcattttatggaagcatttttaaatagcactttttgttagtggtgtggaatttctgcggttattatttttttttttttttgcaacagatgaagcaaaaaaaaaaaagcactcattggagaaatagtgagtgtaaaaagagatttattttgtacagacagcaaagtatcctgtgtaatgttgctgacataaagcactttgggggaaaaaagtggaaatctgttttccataaatcacacagactcttgtacatagttatatacactcacgtagagaaatgaactgcatatatcatactggatatggggccgattttactctagaggcacatctggtgcttattgtcataaatcttttaaagaattaggtacacttttttctattaatatgtatagttttgtgatttgtcacagttatgtttcatataatcataagttattttgtcttgttcatgaagtcctttttttatgtcaaaagtaaaatgaagggattgtgcacttggtacagaataaaactggaaatagagaagacgccctcctgcctaaaatcctccttcagcctgtcggtttaaaacacaatggcaaccatcattgtttgtttgtttgtttttttgttttgttttaccatcagcctcttacatactgggaatggtaattataattaaaggcagatgatgcgggagggaatgttcaagtccagctttaaaatgctgcattgctttgggccagagctgtagcctggatttaattatagatatgaggaggaaatggcagtaaaaatgaatgtctccctgagtcctttacatgttgggagtgtccataaataaaacatgaagttttatttcatcagatttaattaaagcttttatacatgttt

SEQ ID NO: 137174 - DNA, 3961 bp, Homo sapiens
  Payload ID: 6856
  Gene Symbol: GLIS3
  Gene Name: GLIS family zinc finger 3
  Uniprot ID: Q8NEA6
  ENST ID: ENST00000381971
  CDS Start-End: 595-3387
cgggaccccctgtacgccgtccgcgccgtccagggtcacaccggcgacggaacccgccggcagcaattagccagcatcccggggtcggcccccagaagcattccccggcccaggacgaggatgaacaggacaggcgaggcacaaagtcgcaactgaactttttagaaacattatttgtgtgtgtatgtgtgtagcaggggagaatgagctgatgccgagggtccagccaccccgcctctgcctcctcctccccctgccgccgctgccctcgcagacgcgcgcgcacacacggcacttgggccgggtttccgcgctccgtccccccgtttggatgggggttttcatttccgaaggaggcacagcccgcggagcgctctgaagggctggagccccaagttactcctcgccagcgccggccgcccgctgtcactcgcgctggccggccgggggaagggacccgcacgccgggctttgttgtggaaatcccggttacctggcttataacccacaccatggataacttattggactttgcctgaaaggagtcattagtgacattggatatttgaccgtcttggccacaggtttttcagaatgaatggaagatcatgcagcatgagtctccaccggacatcgggaaccccacaggggcctaggatggtcagtggtcatcacattcctgccatccgagcccactccgggactcctggcccctcgccctgtggcagcacatcgagtcccactatggcaagccttgctaacaacctccatctcaagatgccctcaggaggagggatggctcctcagaacaacgtggctgagagccgcatccatctgcctgccttaagccccaggagacaaatgctcaccaatgggaagccgcgattccaggtcacccaggctggaggcatgtcagggtcacatactttaaagccaaagcagcaggagtttggaagcccttttcctccaaatcctgggaaaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatggccttgatctaggggatctccttagccttcctcccgggacatccatgtccagcaatagtgtctctaactcattaccatcctacctttttggcacggaaagtagccactctccttaccctagtcctcggcactcatccaccaggtcccactcggcccgctccaagaagagagcgctgtccttgtccccgctgtccgatggcatcgggatagatttcaataccatcatccgcacgtcgcccacgtccttggtggcctacatcaacgggtcgagggcttcgccggccaacctgtccccgcagccggaggtctacgggcatttcctgggcgtgcgcggcagctgcattccccagccgcgcccggtgcccggcagccagaagggcgtgctggtggcccctggaggcctggcgctgccggcctacggcgaggacggggccctggagcacgagcgcatgcaacagctggagcacggcggcctgcagccaggcctggtcaaccacatggtggtgcagcatggcctgccgggccccgacagccagtcggccggcctgttcaagaccgaacgcctggaggagttcccgggcagcaccgtagacctaccccccgcgcctccgctccctcctctgccgccgcccccaggccccccacccccttaccatgcccatgcgcaccttcaccacccggagctcgggccccacgcccagcagctggccttgccccaggccaccctggacgacgacggggagatggacggcatcgggggcaagcattgctgccgctggatcgactgcagcgccctgtacgaccagcaggaggagctcgtgcggcacatcgagaaggtccacatcgaccagcgcaaaggggaggacttcacttgcttctgggccggttgccctcgaagatacaagcccttcaacgcccgctataaactgctgatccacatgagagtccactctggggagaagcccaacaagtgtacgtttgaaggttgcgagaaggccttttcaaggcttgaaaatctcaagatccacttgcggagccacacaggcgagaagccgtatttgtgccagcatccgggttgtcagaaggccttcagtaactccagtgaccgcgccaaacaccagcggacgcatctggacaccaaaccttatgcttgtcaaattccaggatgtaccaaacgctacacagacccaagttccctaagaaagcatgtgaaggcacattcttccaaagagcaacaagcaaggaaaaagttgcggtccagcacagagctccatccagacctgctcacagattgcctcaccgtgcagtccctgcagccggccacttcccctagagatgctgctgctgaagggaccgtgggacgctcccctggacccgggcctgacctctattcagctcccattttctccagcaattattcaagccgaagtggaacagctgctggggccgtaccacccccacatcctgtcagtcacccttctccaggacataatgtacaggggagccctcacaacccctcctcccagttacctccactcacagctgtggacgcaggagctgagaggtttgcaccttctgctccatctcctcaccacatcagcccccggagagttccagctccttcttcaatactgcaaagaacacagcctccctatacccagcagccatcaggttcacacctgaagtcctatcagccagaaacaaactcttcttttcaaccaaatggtatccatgtccatggattttatgggcagctgcagaagttctgtcccccacactaccccgattcccagagaattgtgccgcctgtcagctcctgcagtgtggtgccttcgtttgaggactgcctagtccctacatccatgggccaggccagttttgatgttttccacagagccttctcgactcactcgggcattacagtgtatgatttaccttcaagttcctcgagcctctttggggagtctctccgcagcggggctgaagatgctaccttcttgcagatcagcaccgtggaccgctgtcctagccagctctcctctgtctacaccgaaggctaaaagctctcttggccactcctgcacacccaggaccttgatgttgcttgccaccttttgttttcgtactctcacagactgcttgaggaaggatgtcagcccaatcagcgggccctgcagagttactgatgttctttcagaaggcaggactgaatggcagagctagctttgcaggaatcattacagttgctcctttttctctctggttttcctggactatgtgaccaggaggactgtcttttcaaagggaatttagagcctcactctcctggatacctgttacttcctggctgtcaacccttaaaggaccccagtgaaatgatgtgcatatgaaaatgtagtttggggatgactctacctgaaaactccaaacagggaaaaagacctcaattacgagaggcatagtgacctgcctcacctaatcctcacccttgctgctcctgatgcaaagccaggcacaacaagggaaatccatgtccaaagcatagtgtggtctcaactcttagaaactccctgggtttcccttttctcttagccacatgctaaccagttgcttctcagtgtttctcttcaatag

SEQ ID NO: 137175 - DNA, 1327 bp, Homo sapiens
  Payload ID: 6856
  Gene Symbol: GLIS3
  Gene Name: GLIS family zinc finger 3
  ENST ID: ENST00000477901
  CDS Start-End: 595-1327
cgggaccccctgtacgccgtccgcgccgtccagggtcacaccggcgacggaacccgccggcagcaattagccagcatcccggggtcggcccccagaagcattccccggcccaggacgaggatgaacaggacaggcgaggcacaaagtcgcaactgaactttttagaaacattatttgtgtgtgtatgtgtgtagcaggggagaatgagctgatgccgagggtccagccaccccgcctctgcctcctcctccccctgccgccgctgccctcgcagacgcgcgcgcacacacggcacttgggccgggtttccgcgctccgtccccccgtttggatgggggttttcatttccgaaggaggcacagcccgcggagcgctctgaagggctggagccccaagttactcctcgccagcgccggccgcccgctgtcactcgcgctggccggccgggggaagggacccgcacgccgggctttgttgtggaaatcccggttacctggcttataacccacaccatggataacttattggactttgcctgaaaggagtcattagtgacattggatatttgaccgtcttggccacaggtttttcagaatgaatggaagatcatgcagcatgagtctccaccggacatcgggaaccccacaggggcctaggatggtcagtggtcatcacattcctgccatccgagcccactccgggactcctggcccctcgccctgtggcagcacatcgagtcccactatggcaagccttgctaacaacctccatctcaagatgccctcaggaggagggatggctcctcagaacaacgtggctgagagccgcatccatctgcctgccttaagccccaggagacaaatgctcaccaatgggaagccgcgattccaggtcacccaggctggaggcatgtcagggtcacatactttaaagccaaagcagcaggagtttggaagcccttttcctccaaatcctgggaaaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatg

SEQ ID NO: 137176 - DNA, 944 bp, Homo sapiens
  Payload ID: 6856
  Gene Symbol: GLIS3
  Gene Name: GLIS family zinc finger 3
  ENST ID: ENST00000481827
  CDS Start-End: 212-944
agttccaagttactcactggagctgacaagtcacctcggggaccgggaagtcactcaagtgtctggaaatcttggccctggctgatttgtcatcctatggatgattcaattaggcttataacccacaccatggataacttattggactttgcctgaaaggagtcattagtgacattggatatttgaccgtcttggccacaggtttttcagaatgaatggaagatcatgcagcatgagtctccaccggacatcgggaaccccacaggggcctaggatggtcagtggtcatcacattcctgccatccgagcccactccgggactcctggcccctcgccctgtggcagcacatcgagtcccactatggcaagccttgctaacaacctccatctcaagatgccctcaggaggagggatggctcctcagaacaacgtggctgagagccgcatccatctgcctgccttaagccccaggagacaaatgctcaccaatgggaagccgcgattccaggtcacccaggctggaggcatgtcagggtcacatactttaaagccaaagcagcaggagtttggaagcccttttcctccaaatcctgggaaaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatg

SEQ ID NO: 137177 - DNA, 458 bp, Homo sapiens
  Payload ID: 6856
  Gene Symbol: GLIS3
  Gene Name: GLIS family zinc finger 3
  ENST ID: ENST00000478844
  CDS Start-End: 191-458
agttccaagttactcactggagctgacaagtcacctcggggaccgggaagtcactcaagtgtctggaaatcttggccctggctgatttgtcatcctatggatgattcaattaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatg

SEQ ID NO: 137178 - DNA, 700 bp, Homo sapiens
  Payload ID: 6856
  Gene Symbol: GLIS3
  Gene Name: GLIS family zinc finger 3
  ENST ID: ENST00000462164
  CDS Start-End: 433-700
actgacctcatccatagtgtggtgtttggtctatgagcagttgattcaccagttttcagagcccaagtctaaaatcacagatcctgtgggggatctgggagcatctgccttacctttatgaaggttatggtcagttaagccttgctttcaatgggctcacttcgctatgggaagaaaattctgcagttgttaaaaacaaaaggacactgccttttccaagggagctgacagctattggtttttccggagaggattactggtgaagacagttatgaagaacaagtaactcttgtaaataaacagcatgttcttgcttaaatatttcccagaacagttctaaagaaatataatacaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatg

SEQ ID NO: 137179 - DNA, 693 bp, Homo sapiens
  Payload ID: 6856
  Gene Symbol: GLIS3
  Gene Name: GLIS family zinc finger 3
  ENST ID: ENST00000478315
  CDS Start-End: 426-693
catttgtcagatgctttcctctctgcactccagcctttgctgaatgtcctggcagttcctgaatgttcctgctgcctgcattttataaaaccaaagagcaagtagccctggaaatgtatgccaagtactctgcacagctgtctgaggcccccagccaagggcaagatataaacaatctatacccacacaggtacacaagcagacactgcatatggaagccccgcagtgcaaggacttcttacttctaacactttaaaatgtcagtggccaaacagcctgagaacatgaataatttaagcatgagatgcttttgctgatgattttgatcatttttcaggaagaataatggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatg

SEQ ID NO: 137180 - DNA, 797 bp, Homo sapiens
  Payload ID: 6856
  Gene Symbol: GLIS3
  Gene Name: GLIS family zinc finger 3
  ENST ID: ENST00000491889
  CDS Start-End: 273-701
cccgtttggatgggggttttcatttccgaaggaggcacagcccgcggagcgctctgaagggctggagccccaagttactcctcgccagcgccggccgcccgctgtcactcgcgctggccggccgggggaagggacccgcacgccgggctttgttgtggaaatcccggttacctggcttataacccacaccatggataacttattggactttgcctgaaaggagtcattagtgacattggatatttgaccgtcttggccacaggtttttcagaatgaatggaagatcatgcagcatgagtctccaccggacatcgggaaccccacaggggcctaggatggtcagtggtcatcacattcctgccatccgagcccactccgggactcctggcccctcgccctgtggcagcacatcgagtcccactatggcaagccttgctaacaacctccatctcaagatgccctcaggaggagggatggctcctcagaacaacgtggctgagagccgcatccatctgcctgccttaagccccaggagacaaatgctcaccaatgggaagccgcgattccaggtcacccaggctggaggcatgtcagggtcacatactttaaagccaaagcagcaggagtttggaagcccttttcctccaaatcctgggaaaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatg

SEQ ID NO: 137181 - DNA, 871 bp, Homo sapiens
  Payload ID: 6857
  Gene Symbol: GBGT1
  Gene Name: globoside alpha-1,3-N-acetylgalactosaminyltransferase 1
  ENST ID: ENST00000372036
  CDS Start-End: 263-481
cggccccgctgcctgccctgctccaggctccacctgcgccgccgatcgcccgggtatcgcgggggcccaggccagctgagtccgttttccgcgccggggtggcgcccctccaaccgtcctaacgccgggccggcagcaaggagtgttcctgggacctcagagaccaggctcagagcctgacatccctgcgaggggacagcctcatccgcccaggccagtgggggtctctacaagtgcccaggctcaggtgcagcccccagcaatgcatcgccggagactggccctgggtctggggttctgcctgttggcgggcacaagcctcagtgtcctgtgggtgtatcttgagaactggctgccagtctcctatgtcccctattatctcccctgcccagagatcttgctggagtaccgtggcgtgatctcagctcattgcaacctccacctcccgggttcaagcaattgtcatgcctcagccacctgaatagctgggattacaggcacacacgctaatttttgtatttttagtagaaacagcatttcatcatgttggccaggttggtctttgcccccttcggccaggcttcgccccctcatcggcctcccaaagtgctgggattaaaggcgtgaaccaccacccctggccttaatttttttttttttttattattactagtgagactctcatttccctacgtcttcccgttaattgaaatttttcttgtgtgaagtgcttcttccccaccttctctgtttggtccgtttgtgggttctctatcatcactcttggctaagtatacctacaacttttttttttctttccagtttgtctatcttgtgtgtgtgcgtggcggagggagataaggtctggctc

SEQ ID NO: 137182 - DNA, 847 bp, Homo sapiens
  Payload ID: 6857
  Gene Symbol: GBGT1
  Gene Name: globoside alpha-1,3-N-acetylgalactosaminyltransferase 1
  ENST ID: ENST00000372038
  CDS Start-End: 265-747
cgcggccccgctgcctgccctgctccaggctccacctgcgccgccgatcgcccgggtatcgcgggggcccaggccagctgagtccgttttccgcgccggggtggcgcccctccaaccgtcctaacgccgggccggcagcaaggagtgttcctgggacctcagagaccaggctcagagcctgacatccctgcgaggggacagcctcatccgcccaggccagtgggggtctctacaagtgcccaggctcaggtgcagcccccagcaatgcatcgccggagactggccctgggtctggggttctgcctgttggcgggcacaagcctcagtgtcctgtgggtgtatcttgagaactggctgccagtctcctatgtcccctattatctcccctgcccagagatcttacccatgatgatggctctttcttgcctctgccaccagcaacatgaagctgcactacaagagggagaagccactccagcccgtggtatggtcacagtaccctcagcccaagctgctggagcacaggcccacacagctgctgacactcacaccctggttggcgcccatcgtctccgagggaaccttcaacccagagcttctgcagcacatctaccagccactgaacctgaccattggggtcacggtgtttgccgtggggaagtacactcatttcatccagtccttcctggagtcagccgaggagttcttcatgcgtgggtaccgggtgcactactacatcttcactgacaaccctgcagccgttcccggggtcccgctgggtccccaccggcttctcagctccatccccatccagggtcactcccactgggaggagacatccatgcgc

SEQ ID NO: 137183 - DNA, 1980 bp, Homo sapiens
  Payload ID: 6857
  Gene Symbol: GBGT1
  Gene Name: globoside alpha-1,3-N-acetylgalactosaminyltransferase 1
  Uniprot ID: Q8N5D6
  ENST ID: ENST00000372040
  CDS Start-End: 313-1356
ctcttttctgtcctctttcctgtctgtcttcctcttttctgtctggcccgcggccccgctgcctgccctgctccaggctccacctgcgccgccgatcgcccgggtatcgcgggggcccaggccagctgagtccgttttccgcgccggggtggcgcccctccaaccgtcctaacgccgggccggcagcaaggagtgttcctgggacctcagagaccaggctcagagcctgacatccctgcgaggggacagcctcatccgcccaggccagtgggggtctctacaagtgcccaggctcaggtgcagcccccagcaatgcatcgccggagactggccctgggtctggggttctgcctgttggcgggcacaagcctcagtgtcctgtgggtgtatcttgagaactggctgccagtctcctatgtcccctattatctcccctgcccagagatcttcaacatgaagctgcactacaagagggagaagccactccagcccgtggtatggtcacagtaccctcagcccaagctgctggagcacaggcccacacagctgctgacactcacaccctggttggcgcccatcgtctccgagggaaccttcaacccagagcttctgcagcacatctaccagccactgaacctgaccattggggtcacggtgtttgccgtggggaagtacactcatttcatccagtccttcctggagtcagccgaggagttcttcatgcgtgggtaccgggtgcactactacatcttcactgacaaccctgcagccgttcccggggtcccgctgggtccccaccggcttctcagctccatccccatccagggtcactcccactgggaggagacatccatgcgccggatggagaccatcagccagcacattgctaagagggctcaccgggaggtggactacctcttctgccttgatgtggacatggtgtttcggaacccgtggggccctgagaccttgggagacctggtggctgccattcacccaagctactacgccgttccccgccagcagttcccctatgagcgcaggcgtgtttccactgcctttgtggcagacagcgaaggggacttctattatggtggggcagtcttcggggggcaggtggccagggtatatgagtttactaggggctgccacatggccatcctggcggacaaggccaatggcatcatggctgcctggcgggaggaaagccacctgaaccgtcacttcatctcaaacaagccgtccaaggtgctgtcccccgagtacctctgggacgacaggaagccccagccacccagcctgaagctgatccgcttttctacactggacaaggatatcagctgcctgaggagctgaccacggagctgggggttgccatggatggggacccaaagacctgcagccaccagtgcttcactagcgtgcagaccagccctgtcccgcctccctgtcagtcaggcgaattcaaccggaaaagggacgtggaaaggccactgtgaactgcagagggctgtgcacacagtagcacacaggatctcacagtaacgcggcatgggaacagtgagacagggggaggggaggcgcagttacaaaggcagggcccggcaggcttgccacgttctgcagccgtgcctttgcggggcaggctctgaagcctcagcccgactcagagtgcctgaaccctgccgcgccagtcccccgtttattgcatattgcccttaacgtagcatttctaataccctggtgtgaaggcgccctagaccccttttctctggtcacaggggtcctgggtcctttgatgtctcccaaccacatgtagccaattcctcactcaggcccccagagtgagcctttgaaatggaacaggtctaggctccctcggtttcctgcaccccaaagtgagccgcactctcaggggactagccacctccttcttaagagggtttggggcagtttataataaagggggcgtgtgctcaa

SEQ ID NO: 137184 - DNA, 1935 bp, Homo sapiens
  Payload ID: 6857
  Gene Symbol: GBGT1
  Gene Name: globoside alpha-1,3-N-acetylgalactosaminyltransferase 1
  Uniprot ID: Q8N5D6
  ENST ID: ENST00000372043
  CDS Start-End: 287-1171
tcttcctcttttctgtctggcccgcggccccgctgcctgccctgctccaggctccacctgcgccgccgatcgcccgggtatcgcgggggcccaggccagctgagtccgttttccgcgccggggtggcgcccctccaaccgtcctaacgccgggccggcagcaaggagtgttcctgggacctcagagaccaggctcagagcctgacatccctgcgaggggacagcctcatccgcccaggccagtgggggtctctacaagtgcccaggctcaggtgcagcccccagcaatgcatcgccggagactggccctgggtctggggttctgcctgttggcgggcacaagcctcagtgtcctgtgggtgtatcttgagaactggctgccagtctcctatgtcccctattatctcccctgcccagagatcttcaacatgaagctgcactacaagagggagaagccactccagcccgtggtatggtcacagtaccctcagcccaagctgctggagcacaggcccacacagctgctgacactcacaccctggttggcgcccatcgtctccgagggaaccttcaacccagagcttctgcagcacatctaccagccactgaacctgaccattggggtcacggtgtttgccgtggggaatccttcctggagtcagccgaggagttcttcatgcgtgggtaccgggtgcactactacatcttcactgacaaccctgcagccgttcccggggtcccgctgggtccccaccggcttctcagctccatccccatccagggtcactcccactgggaggagacatccatgcgccggatggagaccatcagccagcacattgctaagagggctcaccgggaggtggactacctcttctgccttgatgtggacatggtgtttcggaacccgtggggccctgagaccttgggagacctggtggctgccattcacccaagctactacgccgttccccgccagcagttcccctatgagcgcaggcgtgtttccactgcctttgtggcagacagcgaaggggacttctattatggtggggcagtcttcggggggcaggtggccagggtatatgagtttactaggggctgccacatggccatcctggcggacaaggccaatggcatcatggctgcctggcgggaggaaagccacctgaaccgtcacttcatctcaaacaagccgtccaaggtgctgtcccccgagtacctctgggacgacaggaagccccagccacccagcctgaagctgatccgcttttctacactggacaaggatatcagctgcctgaggagctgaccacggagctgggggttgccatggatggggacccaaagacctgcagccaccagtgcttcactagcgtgcagaccagccctgtcccgcctccctgtcagtcaggcgaattcaaccggaaaagggacgtggaaaggccactgtgaactgcagagggctgtgcacacagtagcacacaggatctcacagtaacgcggcatgggaacagtgagacagggggaggggaggcgcagttacaaaggcagggcccggcaggcttgccacgttctgcagccgtgcctttgcggggcaggctctgaagcctcagcccgactcagagtgcctgaaccctgccgcgccagtcccccgtttattgcatattgcccttaacgtagcatttctaataccctggtgtgaaggcgccctagaccccttttctctggtcacaggggtcctgggtcctttgatgtctcccaaccacatgtagccaattcctcactcaggcccccagagtgagcctttgaaatggaacaggtctaggctccctcggtttcctgcaccccaaagtgagccgcactctcaggggactagccacctccttcttaagagggtttggggcagtttataataaagggggcgtgtgctcaa

SEQ ID NO: 137185 - DNA, 1934 bp, Homo sapiens
  Payload ID: 6857
  Gene Symbol: GBGT1
  Gene Name: globoside alpha-1,3-N-acetylgalactosaminyltransferase 1
  Uniprot ID: Q8N5D6
  ENST ID: ENST00000540636
  CDS Start-End: 313-1305
ctcttttctgtcctctttcctgtctgtcttcctcttttctgtctggcccgcggccccgctgcctgccctgctccaggctccacctgcgccgccgatcgcccgggtatcgcgggggcccaggccagctgagtccgttttccgcgccggggtggcgcccctccaaccgtcctaacgccgggccggcagcaaggagtgttcctgggacctcagagaccaggctcagagcctgacatccctgcgaggggacagcctcatccgcccaggccagtgggggtctctacaagtgcccaggctcaggtgcagcccccagcaatgcatcgccggagactggccctgggtctggggttctgcctgttggcgggcacaagcctcagtgtcctgtgggtgtatcttgagaactggctgccagtctcctatgtcccctattatctcccctgcccagagatcttgtcacagtaccctcagcccaagctgctggagcacaggcccacacagctgctgacactcacaccctggttggcgcccatcgtctccgagggaaccttcaacccagagcttctgcagcacatctaccagccactgaacctgaccattggggtcacggtgtttgccgtggggaagtacactcatttcatccagtccttcctggagtcagccgaggagttcttcatgcgtgggtaccgggtgcactactacatcttcactgacaaccctgcagccgttcccggggtcccgctgggtccccaccggcttctcagctccatccccatccagggtcactcccactgggaggagacatccatgcgccggatggagaccatcagccagcacattgctaagagggctcaccgggaggtggactacctcttctgccttgatgtggacatggtgtttcggaacccgtggggccctgagaccttgggagacctggtggctgccattcacccaagctactacgccgttccccgccagcagttcccctatgagcgcaggcgtgtttccactgcctttgtggcagacagcgaaggggacttctattatggtggggcagtcttcggggggcaggtggccagggtatatgagtttactaggggctgccacatggccatcctggcggacaaggccaatggcatcatggctgcctggcgggaggaaagccacctgaaccgtcacttcatctcaaacaagccgtccaaggtgctgtcccccgagtacctctgggacgacaggaagccccagccacccagcctgaagctgatccgcttttctacactggacaaggatatcagctgcctgaggagctgaccacggagctgggggttgccatggatggggacccaaagacctgcagccaccagtgcttcactagcgtgcagaccagccctgtcccgcctccctgtcagtcaggcgaattcaaccggaaaagggacgtggaaaggccactgtgaactgcagagggctgtgcacacagtagcacacaggatctcacagtaacgcggcatgggaacagtgagacagggggaggggaggcgcagttacaaaggcagggcccggcaggcttgccacgttctgcagccgtgcctttgcggggcaggctctgaagcctcagcccgactcagagtgcctgaaccctgccgcgccagtcccccgtttattgcatattgcccttaacgtagcatttctaataccctggtgtgaaggcgccctagaccccttttctctggtcacaggggtcctgggtcctttgatgtctcccaaccacatgtagccaattcctcactcaggcccccagagtgagcctttgaaatggaacaggtctaggctccctcggtttcctgcaccccaaagtgagccgcactctcaggggactagccacctccttcttaagagggtttggggcagtttataataaagggggcgtgtgctcaacccta

SEQ ID NO: 137186 - DNA, 1995 bp, Homo sapiens
  Payload ID: 6858
  Gene Symbol: GLMN
  Gene Name: glomulin, FKBP associated protein
  Uniprot ID: Q92990
  ENST ID: ENST00000370360
  CDS Start-End: 83-1867
ctaagacgccggaggaggtggcggcggctgggagaggcgagggttctggccgattttagcatcgaaactaggagaaataagaatggctgtagaggaacttcagtctataataaagagatgtcaaatcctagaagagcaagactttaaagaagaggattttggcctatttcagttagctgggcaaagatgcatagaagaagggcacacagaccagctattagaaattattcaaaatgaaaagaataaggtcatcatcaagaatatgggctggaatctcgttggtcctgttgttcgatgccttttgtgtaaagataaagaggatagtaaaagaaaagtttattttttgatctttgatttattggtaaagttatgcaatccaaaggaattattgttgggtttgcttgaactgattgaagagccctctggaaaacagatatcccaaagtattcttcttttgcttcagccattacaaacagtgattcagaaacttcataacaaggcatattcaattggattagcattgtctaccctttggaatcagctatctcttcttcctgttccatactcaaaagaacaaatacaaatggatgactatggcctttgtcagtgttgcaaggccttaatagagttcactaagccttttgtggaagaagtcattgataacaaagaaaactcactggaaaatgaaaagttaaaggatgaattactgaaattttgtttcaaaagcttgaaatgccctttgctgacagcacaattctttgaacagtctgaagaaggtggaaatgatcctttcaggtattttgcatcagaaataataggttttttatcagcaattggacaccctttccccaaaatgatttttaatcatggaaggaaaaagagaacttggaattaccttgaatttgaagaagaagaaaataaacagttagcagactcaatggcttctctggcatatctagtatttgtacagggcatccatattgatcagcttccaatggtcttaagcccattgtaccttttgcagtttaatatggggcacattgaagtctttttgcaaagaacagaagagtctgttatctccaaaggattggagctgctggagaatagtttattgagaatagaagacaatagtctactttaccagtacttagaaatcaagagttttcttactgtacctcagggcttagtgaaagtaatgacactttgccccattgagacactgaggaaaaagagtttagctatgcttcagctgtatattaacaagttggattcacaaggcaaatatacattatttaggtgcttattgaatacaagtaatcactcaggtgtggaggcttttattattcaaaatatcaaaaatcaaattgacatgtcattaaagagaacacgtaacaacaaatggtttacaggaccacagttgatttcccttcttgatttggtactttttctcccagagggtgcagaaacagatttactgcaaaactcagataggattatggcttcattaaatttattgaggtatttggttatcaaagataatgaaaatgacaatcaaactggattatggacagaacttggaaatattgagaataatttcttaaagccacttcatataggacttaatatgtcaaaagcacattatgaagcagaaattaaaaatagccaagaggcccagaaatctaaagatctttgttctataactgtaagtggagaagagatccctaatatgcctcctgaaatgcagcttaaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtactttccattatgattcatttaatacctttataaaaaatttttctgtaaaaatttactgcttgaaaaataaatgtagcttttctcattta

SEQ ID NO: 137187 - DNA, 1833 bp, Homo sapiens
  Payload ID: 6858
  Gene Symbol: GLMN
  Gene Name: glomulin, FKBP associated protein
  Uniprot ID: Q92990
  ENST ID: ENST00000495106
  CDS Start-End: 94-1347
agaagagcgggctaagacgccggaggaggtggcggcggctgggagaggcgagggttctggccgattttagcatcgaaactaggagaaataagaatggctgtagaggaacttcagtctataataaagagatgtcaaatcctagaagagcaagactttaaagaagaggattttggcctatttcagttagctgggcaaagatgcatagaagaagggcacacagaccagctattagaaattattcaaaatgaaaagaataaggtcatcatcaagaatatgggctggaatctcgttggtcctgttgttcgatgccttttgtgtaaagataaagaggatagtaaaagaaaagtttattttttgatctttgatttattggtaaagttatgcaatccaaaggaattattgttgggtttgcttgaactgattgaagagccctctggaaaacagatatcccaaagtattcttcttttgcttcagccattacaaacagtgattcagaaacttcataacaaggcatattcaattggattagcattgtctaccctttggaatcagctatctcttcttcctgttccatactcaaaagaacaaatacaaatggatgactatggcctttgtcagtgttgcaaggccttaatagagttcactaagccttttgtggaagaagtcattgataacaaagaaaactcactggaaaatgaaaagttaaaggatgaattactgaaattttgtttcaaaagcttgaaatgccctttgctgacagcacaattctttgaacagtctgaagaaggtggaaatgatcctttcaggtattttgcatcagaaataataggttttttatcagcaattggacaccctttccccaaaatgatttttaatcatggaaggaaaaagagaacttggaattaccttgaatttgaagaagaagaaaataaacagttagcagactcaatggcttctctggcatatctagtatttgtacagggcatccatattgatcagcttccaatggtcttaagcccattgtaccttttgcagtttaatatggggcacattgaagtctttttgcaaagaacagaagagtctgttatctccaaaggattggagctgctggagaatagtttattgagaatagaagacaatagtctactttaccagtacttagaaatcaagagttttcttactgtacctcagggcttagtgaaagtaatgacactttgccccattgagacactgaggaaaaagagtttagctatgcttcagctgtatattaacaagttggattcacaaggcaaatatacattatttagagaacacgtaacaacaaatggtttacaggaccacagttgatttcccttcttgatttggtactttttctcccagagggtgcagaaacagatttactgcaaaactcagataggattatggcttcattaaatttattgaggtatttggttatcaaagataatgaaaatgacaatcaaactggattatggacagaacttggaaatattgagaataatttcttaaagccacttcatataggacttaatatgtcaaaagcacattatgaagcagaaattaaaaatagccaagaggcccagaaatctaaagatctttgttctataactgtaagtggagaagagatccctaatatgcctcctgaaatgcagcttaaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtac

SEQ ID NO: 137188 - DNA, 734 bp, Homo sapiens
  Payload ID: 6858
  Gene Symbol: GLMN
  Gene Name: glomulin, FKBP associated protein
  ENST ID: ENST00000463560
  CDS Start-End: 1-734
ttgtttcaaaagcttgaaatgccctttgctgacagcacaattctttgaacagtctgaagaaggtggaaatgatcctttcaggtattttgcatcagaaataataggttttttatcagcaattggacaccctttccccaaaatgatttttaatcatggaaggaaaaagagaacttggaattaccttgaatttgaagaagaagaaaataaacagttagcagactcaatggcttctctggcatatctagtatttgtacagggcatccatattgatcagcttccaatggtcttaagcccattgtaccttttgcagtttaatatggggcacattgaagtctttttgcaaagaacagaagagtctgttatctccaaaggattggagctgctggagaatagtttattgagaatagaagacaatagtctactttaccagtacttagaaatcaagagttttcttactgtacctcagggcttagtgaaagtaatgacactttgccccattgagacactggaggtacaagtgtggatgtattacatgcataaaatggatagtgatgaagtctggagaacacgtaacaacaaatggtttacaggaccacagttgatttcccttcttgatttggtactttttctcccagagggtgcagaaacagatttactgcaaaactcagataggattatggcttcattaaatttattgaggtatttggttatcaaagataatgaaaatgacaatc

SEQ ID NO: 137189 - DNA, 891 bp, Homo sapiens
  Payload ID: 6858
  Gene Symbol: GLMN
  Gene Name: glomulin, FKBP associated protein
  ENST ID: ENST00000495852
  CDS Start-End: 1-891
ggttttttatcagcaattggacaccctttccccaaaatgatttttaatcatggaaggaaaaagagaacttggaattaccttgaatttgaagaagaagaaaataaacagttagcagactcaatggcttctctggcatatctagtatttgtacagggcatccatattgatcagcttccaatggtcttaagcccattgtaccttttgcagtttaatatggggcacattgaagtctttttgcaaagaacagaagagtctgttatctccaaaggattggagctgctggagaatagtttattgagaatagaagacaatagtctactttaccagtacttagaaatcaagagttttcttactgtacctcagaggaaaaagagtttagctatgcttcagctgtatattaacaagttggattcacaaggcaaatatacattatttaggtgcttattgaatacaagtaatcactcaggtgtggaggcttttattattcaaaatatcaaaaatcaaattgacatgtcattaaagagaacacgtaacaacaaatggtttacaggaccacagttgatttcccttcttgatttggtactttttctcccagagggtgcagaaacagatttactgcaaaactcagataggattatggcttcattaaatttattgaggtatttggttatcaaagataatgaaaatgacaatcaaactggattatggacagaacttggaaatattgagaataatttcttaaagccacttcatataggacttaatatgtcaaaagcacattatgaagcagaaattaaaaatagccaagaggcccagaaatctaaagatctttgttctataactgtaagtggagaagagatccctaatatgcctcctgaaatgcagcttaag

SEQ ID NO: 137190 - DNA, 6530 bp, Homo sapiens
  Payload ID: 6859
  Gene Symbol: GLTSCR1L
  Gene Name: GLTSCR1-like
  Uniprot ID: Q6AI39
  ENST ID: ENST00000314073
  CDS Start-End: 177-3416
cgccgccgccgccgccgccgcccctgttgcgatggcgcagaaaccccgttgacaaggcactgctttttcatgacgcaaaacgtcatattatttcacaaaaagcccagcgatttcacctgaagaagcttgggaactcctgccaaaaattgtagcacttctcacattgcaatgttgtcatggatgatgatgatgactcgtgtctccttgatcttattggagacccacaagcattgaactattttctacatggacctagtaataaatctagcaatgatgacttgactaatgcaggatattctgcagccaattcaaattcaattttcgccaactctagtaatgctgatcctaagtcatccctcaaaggtgtaagcaaccagcttggagaagggcccagtgatggactgccactttcaagtagcctccagtttcttgaagatgaactcgagtcttctcctcttcctgatctcactgaggaccaacctttcgacattcttcagaaatccttgcaagaggccaatatcactgaacagacattggcagaagaggcatatttggatgccagtataggttcaagccaacagtttgcacaagctcagcttcatccttcttcatcagcatcctttactcaggcttctaatgtttctaattactcaggtcagacgctgcagcctataggggtgacgcatgtgcctgttggagcatcgtttgcaagcaatacagtgggtgtacaacatggctttatgcaacatgtggggatcagtgttcccagccagcatttgtctaatagcagtcagattagtggttctggtcaaatacagttaattgggtcatttggtaatcatccttccatgatgactattaataacctagatggatctcaaatcatattaaagggcagcgggcagcaagccccatcaaatgtgagtggagggctcctggttcatagacagactcctaatggcaactccttgtttgggaactctagttccagtccagtagcacagcctgttaccgttccatttaacagcacaaattttcaaacatctttacctgtgcataacatcatcatacaaaggggtcttgcaccaaattcaaataaagtcccaattaatatacagccaaagcctatccagatgggtcagcaaaatacatacaatgtgaacaatttgggaattcagcagcaccacgtacaacaagggatctcttttgcttctgcaagctcaccccagggctcagtagttggtccacacatgtctgtgaacattgtaaaccaacagaacacaagaaagccagtcacctcacaggcagtgagcagcactgggggcagtattgttattcattcccccatgggccaacctcacgcaccccaaagtcagttccttatacctacaagcctttctgtcagttccaactcggtacaccacgtccagactataaatgggcaacttcttcaaactcaaccctctcagctcatttctggccaagtggcctcagagcatgtcatgttgaacagaaactcttccaacatgctcaggaccaaccaaccatatactggaccgatgcttaacaaccagaatactgctgtccacttagtgtctgggcagacatttgctgcctctggaagtccagtgatagccaatcatgcctctcctcagcttgtgggtggacagatgcccttgcagcaggcatccccaactgtattacacctgtcacctgggcagagcagcgtttcccaaggaagacctggcttcgccaccatgccatcggtgacaagcatgtcaggacctagtcggttccctgctgtcagctcagccagcactgcccatcctagtcttgggtctgcagttcagtctggttcatcaggatcaaactttacaggagatcagctgacccagccaaacaggactccagtaccagtcagtgtgtctcatcgtcttccagtttcttcttccaagtctaccagcaccttcagtaacacacctggaacaggaacccagcaacaattcttctgccaggctcagaaaaaatgtctgaatcagacttcccccatttctgctcccaagaccacagacggcctgaggcaagcacagatccctgggctcttgagcaccacactgccagggcaggattctggaagcaaagttatatccgcatccttaggaaccgcacaaccacagcaggaaaaagtagttggatcatctcctggccatccagctgtgcaggtggagagtcattcgggaggacaaaaaaggcctgctgcgaaacagctaacgaaaggagctttcattctccagcagttgcagagggaccaagcccacactgtgacaccagacaaaagtcacttccgatcactaagtgatgcggtacagagactgctctcctaccacgtgtgccagggctccatgcccactgaagaagacttgagaaaagtggacaatgaatttgagacagttgccactcagctcctaaaaaggacccaagctatgcttaacaaatacagatgcctgctcctagaagatgccatgcgaatcaatccctctgctgagatggtgatgatcgataggatgttcaaccaggaggaaagagcttccctgtcccgagacaagcgtttggcacttgtagaccctgagggttttcaggctgatttctgttgttccttcaaacttgataaagctgctcatgagacacagtttggccggagtgaccagcatggcagtaaagcaagcagctctctgcaaccgccagccaaggcccaaggcagagaccgagccaaaaccggtgtgacggaacccatgaatcatgaccagtttcatctagtgcctaatcacatcgtggtctctgcagaaggaaacatttctaaaaaaacagaatgccttggcagagcactgaaatttgacaaagtgggcttagtgcagtaccagagcacgtctgaagagaaggccagccggagagagcctctgaaggccagtcagtgctctcccggccctgaggggcaccggaaaacctcatccagatcggatcatggtactgagagcaaactgtcaagcatcctagcagattcgcacttggagatgacgtgtaacaattccttccaggacaaaagtctgaggaattctccaaagaatgaagttttacacacagacatcatgaaagggtcaggcgaaccccagccagatctccagctgacaaagagcttggaaaccacatttaagaacatcttggaactcaaaaaggcgggacggcagccccagagtgaccccacggttagcggctctgttgagttagatttccccaacttttctcctatggcttcacaggaaaactgcctggaaaagttcatcccggaccacagtgaaggtgttgtagaaactgactccattttagaagcagctgtaaatagtatcctagagtgttaatagcagcagtcctccccctaccccgccccgagaccccaccccgagaccccaccccggaccagttacattcgttcctggcaaaagcaaatggaaatggtctcctgtctccagcctgcttgatctttcatcacaggttattctttctaatctcaatcctgttctttgtttaagagcaatacttgtcgtgattacagggagatcctttagtaaaattaatccttggcagaaagcagtctgataggccccactcatttcaagtgttatgaaagtgcttataggcattttgtttatttgttttgttttttaaaaacactgtaactcaatgagaccacagtatacttggcccttggtaaaattttgacaatcataagtcatttgaaaagaacagacttactaaaatcaaacgagacggatagaagctactttttaaagaatatcccactgcatctgcaaatttagttttgggtttttttattattattattttgagtttttttgtgtgtgttttgttgttattgttgaggggaagaccacatggttcttccccctcagccatctttgagcagtaaattgctggctgtgctgccagggacccgcagccctggtggaaaagccagtagcacatacgcagggcattgcagggcttccctattgatggttcaagtgcttttctgatgcttccggagcaaaacctcatgcttttaggcatatctatgttgaatttcacctagggaatgttctgttcttagttacagcagcaaaatttgaaataatttcaccaggctaaataaaggaaaatggaaaccagttaagaggcacagtgtacagaggaggccgggatagagccatgagggttataatattaatatgtatatatgtaaaagcatatatatgttaactattgagaaaaaacaagttttgcattttataattggatatagtcaacatataatgtatgtttttgtttgttgctggattttgtttcatttaacctctctttgcaccctctcccacaacaaataccaagcatcaaaagcactttcatttgaaaattattatgttgtaatttttcagtttaaactttaaggagactctggccttgtttatgcttcttgtctgagaacagtagtgacccctggcagcaattcattaccaaaacacagacaaaccaaaggtaaccagctagcccaccactgaaaggaaagatctgagacatgggattcccatttgagagccaaaggatatgccctgtcatggtttctgtttggcctgtgttcatattagtgagcatggcttactgctttatttatttttatttcttgtcagggagtattctccgttttcctttctcgtatacctgccccaggttatcccatttctgttgttacctttattcttaatgtcattgtaaccatcacttatctcctctcattgggaaagctacatgatagtatttttatgcactcttctcccacacatacacacacgtgcatgtatctgagctgctcggatccagaggtcatttttgttacagtgtgtgcacactcactctccttcttagtgtgcatactctctcatttattctgtttatctccctggctctggaggtgcagccactggtcttcactttaatgtgttgccagaatctgcttctggctgtcgccaacatggggatgacccccattgtcatcatgttgggcatttcttttccagattggcctgtgatggaaaggaaggcttctaattagaaaacacagcaacagaagacctataccccggtgcccctgtgtcccactacacacagaaaaccctgtgagatggccagtcttcataatagcaacgtaccttcaccccagccacatgccccagccaatacaaattggaaaatctggcccattttagggttaccattttttccttatttgtgccaatgtccaagttgcagatttcccctttttcctgtattgtaacatattagataagttggtgtcgccagttggtactttctgtttgggtagtcctagggtaacaccctgccctaaactccatgatttcataggcttttcttcccttggggctcatgctcccctaattcctagcaagatgatccttcctaatcaaattcttctcattgcagaactttatccctggaagccttcatgtgggctgctagtgagttacattaattactgcaaatcagtggaattctcaagagacaagataagcttcatgtacatttgtcacctctctttcttccctatcctgccctgctgtcccaatcctagcttttctatataccatcctaaagggtttttaagccctaacacttgtctagcaaatggagagcctaatttaccaaaatgaaacttgtaaatttttgtgtcattgtatgtaagtttactttttatggaggaaggattctagataatgacaaatgaagattatgacatgtatttcactcctgtgattaggttctacgcacatgggtcataactcgcatgtcgagccccctctagtgaagggtaggagagctcagcctcggatggccaacattcagttgttcaggttcattcgtcaaagttaagttttagaactatttgtactcagtaacaaaaatcattttctttttttttttttttttctgttgtggaaaagcgtgaatttgttattaagcatttgattttctgtgtccttaagtacttcctgaagatgaagcaaaattttaatctggcaattatgaaaaagaaatattttagctctgaaggatttagtagattctgttagattagggaggccttacagactgactttacttaaagaggacgcgtcactcgctgtcagtgtggtgtgggctttatttgcttaaataccttcatttgtatagtacgtctcacttgaaattgctttgtatacattttgtaaaaatatttataaaatgttttgtaaaaaaaaaaaaactataacaaattgcagtttattttgttatgttggataaatactgttaaaagaaaccagtcagtaactatattgttaatccatggttaggaaatgtttagttggagattacaaattgaaacaaccattgcaatacagccaaagatttgggaaaatgtg

SEQ ID NO: 137191 - DNA, 6515 bp, Homo sapiens
  Payload ID: 6859
  Gene Symbol: GLTSCR1L
  Gene Name: GLTSCR1-like
  Uniprot ID: Q6AI39
  ENST ID: ENST00000394168
  CDS Start-End: 164-3403
ggcatcttttcaggatttcattcctacgtccaactgccgttcacaactgccctttccaactgctccagaactcttggccctggcattccgtgatgtaaattattccacacatggctcaaaagggtgtgaagctgtgtgccaggtgtcggatcactagtttgtcatggatgatgatgatgactcgtgtctccttgatcttattggagacccacaagcattgaactattttctacatggacctagtaataaatctagcaatgatgacttgactaatgcaggatattctgcagccaattcaaattcaattttcgccaactctagtaatgctgatcctaagtcatccctcaaaggtgtaagcaaccagcttggagaagggcccagtgatggactgccactttcaagtagcctccagtttcttgaagatgaactcgagtcttctcctcttcctgatctcactgaggaccaacctttcgacattcttcagaaatccttgcaagaggccaatatcactgaacagacattggcagaagaggcatatttggatgccagtataggttcaagccaacagtttgcacaagctcagcttcatccttcttcatcagcatcctttactcaggcttctaatgtttctaattactcaggtcagacgctgcagcctataggggtgacgcatgtgcctgttggagcatcgtttgcaagcaatacagtgggtgtacaacatggctttatgcaacatgtggggatcagtgttcccagccagcatttgtctaatagcagtcagattagtggttctggtcaaatacagttaattgggtcatttggtaatcatccttccatgatgactattaataacctagatggatctcaaatcatattaaagggcagcgggcagcaagccccatcaaatgtgagtggagggctcctggttcatagacagactcctaatggcaactccttgtttgggaactctagttccagtccagtagcacagcctgttaccgttccatttaacagcacaaattttcaaacatctttacctgtgcataacatcatcatacaaaggggtcttgcaccaaattcaaataaagtcccaattaatatacagccaaagcctatccagatgggtcagcaaaatacatacaatgtgaacaatttgggaattcagcagcaccacgtacaacaagggatctcttttgcttctgcaagctcaccccagggctcagtagttggtccacacatgtctgtgaacattgtaaaccaacagaacacaagaaagccagtcacctcacaggcagtgagcagcactgggggcagtattgttattcattcccccatgggccaacctcacgcaccccaaagtcagttccttatacctacaagcctttctgtcagttccaactcggtacaccacgtccagactataaatgggcaacttcttcaaactcaaccctctcagctcatttctggccaagtggcctcagagcatgtcatgttgaacagaaactcttccaacatgctcaggaccaaccaaccatatactggaccgatgcttaacaaccagaatactgctgtccacttagtgtctgggcagacatttgctgcctctggaagtccagtgatagccaatcatgcctctcctcagcttgtgggtggacagatgcccttgcagcaggcatccccaactgtattacacctgtcacctgggcagagcagcgtttcccaaggaagacctggcttcgccaccatgccatcggtgacaagcatgtcaggacctagtcggttccctgctgtcagctcagccagcactgcccatcctagtcttgggtctgcagttcagtctggttcatcaggatcaaactttacaggagatcagctgacccagccaaacaggactccagtaccagtcagtgtgtctcatcgtcttccagtttcttcttccaagtctaccagcaccttcagtaacacacctggaacaggaacccagcaacaattcttctgccaggctcagaaaaaatgtctgaatcagacttcccccatttctgctcccaagaccacagacggcctgaggcaagcacagatccctgggctcttgagcaccacactgccagggcaggattctggaagcaaagttatatccgcatccttaggaaccgcacaaccacagcaggaaaaagtagttggatcatctcctggccatccagctgtgcaggtggagagtcattcgggaggacaaaaaaggcctgctgcgaaacagctaacgaaaggagctttcattctccagcagttgcagagggaccaagcccacactgtgacaccagacaaaagtcacttccgatcactaagtgatgcggtacagagactgctctcctaccacgtgtgccagggctccatgcccactgaagaagacttgagaaaagtggacaatgaatttgagacagttgccactcagctcctaaaaaggacccaagctatgcttaacaaatacagatgcctgctcctagaagatgccatgcgaatcaatccctctgctgagatggtgatgatcgataggatgttcaaccaggaggaaagagcttccctgtcccgagacaagcgtttggcacttgtagaccctgagggttttcaggctgatttctgttgttccttcaaacttgataaagctgctcatgagacacagtttggccggagtgaccagcatggcagtaaagcaagcagctctctgcaaccgccagccaaggcccaaggcagagaccgagccaaaaccggtgtgacggaacccatgaatcatgaccagtttcatctagtgcctaatcacatcgtggtctctgcagaaggaaacatttctaaaaaaacagaatgccttggcagagcactgaaatttgacaaagtgggcttagtgcagtaccagagcacgtctgaagagaaggccagccggagagagcctctgaaggccagtcagtgctctcccggccctgaggggcaccggaaaacctcatccagatcggatcatggtactgagagcaaactgtcaagcatcctagcagattcgcacttggagatgacgtgtaacaattccttccaggacaaaagtctgaggaattctccaaagaatgaagttttacacacagacatcatgaaagggtcaggcgaaccccagccagatctccagctgacaaagagcttggaaaccacatttaagaacatcttggaactcaaaaaggcgggacggcagccccagagtgaccccacggttagcggctctgttgagttagatttccccaacttttctcctatggcttcacaggaaaactgcctggaaaagttcatcccggaccacagtgaaggtgttgtagaaactgactccattttagaagcagctgtaaatagtatcctagagtgttaatagcagcagtcctccccctaccccgccccgagaccccaccccgagaccccaccccggaccagttacattcgttcctggcaaaagcaaatggaaatggtctcctgtctccagcctgcttgatctttcatcacaggttattctttctaatctcaatcctgttctttgtttaagagcaatacttgtcgtgattacagggagatcctttagtaaaattaatccttggcagaaagcagtctgataggccccactcatttcaagtgttatgaaagtgcttataggcattttgtttatttgttttgttttttaaaaacactgtaactcaatgagaccacagtatacttggcccttggtaaaattttgacaatcataagtcatttgaaaagaacagacttactaaaatcaaacgagacggatagaagctactttttaaagaatatcccactgcatctgcaaatttagttttgggtttttttattattattattttgagtttttttgtgtgtgttttgttgttattgttgaggggaagaccacatggttcttccccctcagccatctttgagcagtaaattgctggctgtgctgccagggacccgcagccctggtggaaaagccagtagcacatacgcagggcattgcagggcttccctattgatggttcaagtgcttttctgatgcttccggagcaaaacctcatgcttttaggcatatctatgttgaatttcacctagggaatgttctgttcttagttacagcagcaaaatttgaaataatttcaccaggctaaataaaggaaaatggaaaccagttaagaggcacagtgtacagaggaggccgggatagagccatgagggttataatattaatatgtatatatgtaaaagcatatatatgttaactattgagaaaaaacaagttttgcattttataattggatatagtcaacatataatgtatgtttttgtttgttgctggattttgtttcatttaacctctctttgcaccctctcccacaacaaataccaagcatcaaaagcactttcatttgaaaattattatgttgtaatttttcagtttaaactttaaggagactctggccttgtttatgcttcttgtctgagaacagtagtgacccctggcagcaattcattaccaaaacacagacaaaccaaaggtaaccagctagcccaccactgaaaggaaagatctgagacatgggattcccatttgagagccaaaggatatgccctgtcatggtttctgtttggcctgtgttcatattagtgagcatggcttactgctttatttatttttatttcttgtcagggagtattctccgttttcctttctcgtatacctgccccaggttatcccatttctgttgttacctttattcttaatgtcattgtaaccatcacttatctcctctcattgggaaagctacatgatagtatttttatgcactcttctcccacacatacacacacgtgcatgtatctgagctgctcggatccagaggtcatttttgttacagtgtgtgcacactcactctccttcttagtgtgcatactctctcatttattctgtttatctccctggctctggaggtgcagccactggtcttcactttaatgtgttgccagaatctgcttctggctgtcgccaacatggggatgacccccattgtcatcatgttgggcatttcttttccagattggcctgtgatggaaaggaaggcttctaattagaaaacacagcaacagaagacctataccccggtgcccctgtgtcccactacacacagaaaaccctgtgagatggccagtcttcataatagcaacgtaccttcaccccagccacatgccccagccaatacaaattggaaaatctggcccattttagggttaccattttttccttatttgtgccaatgtccaagttgcagatttcccctttttcctgtattgtaacatattagataagttggtgtcgccagttggtactttctgtttgggtagtcctagggtaacaccctgccctaaactccatgatttcataggcttttcttcccttggggctcatgctcccctaattcctagcaagatgatccttcctaatcaaattcttctcattgcagaactttatccctggaagccttcatgtgggctgctagtgagttacattaattactgcaaatcagtggaattctcaagagacaagataagcttcatgtacatttgtcacctctctttcttccctatcctgccctgctgtcccaatcctagcttttctatataccatcctaaagggtttttaagccctaacacttgtctagcaaatggagagcctaatttaccaaaatgaaacttgtaaatttttgtgtcattgtatgtaagtttactttttatggaggaaggattctagataatgacaaatgaagattatgacatgtatttcactcctgtgattaggttctacgcacatgggtcataactcgcatgtcgagccccctctagtgaagggtaggagagctcagcctcggatggccaacattcagttgttcaggttcattcgtcaaagttaagttttagaactatttgtactcagtaacaaaaatcattttctttttttttttttttttctgttgtggaaaagcgtgaatttgttattaagcatttgattttctgtgtccttaagtacttcctgaagatgaagcaaaattttaatctggcaattatgaaaaagaaatattttagctctgaaggatttagtagattctgttagattagggaggccttacagactgactttacttaaagaggacgcgtcactcgctgtcagtgtggtgtgggctttatttgcttaaataccttcatttgtatagtacgtctcacttgaaattgctttgtatacattttgtaaaaatatttataaaatgttttgtaaaaaaaaaaaaactataacaaattgcagtttattttgttatgttggataaatactgttaaaagaaaccagtcagtaactatattgttaatccatggttaggaaatgtttagttggagattacaaattgaaacaaccattgcaatacagccaaagatttgggaaaatg

SEQ ID NO: 137192 - DNA, 6510 bp, Homo sapiens
  Payload ID: 6859
  Gene Symbol: GLTSCR1L
  Gene Name: GLTSCR1-like
  Uniprot ID: Q6AI39
  ENST ID: ENST00000614467
  CDS Start-End: 327-3566
ccctgccctccccgagctcggtcccggccactccctccgcagctgggcgtcgccggccgcgctggggcgagaaccgaagtttggaggtagacgagcaggcgagcggtttgcccgggcgcagagcatgaaggccgggcgggcgcggggagcggcgcccgccgccgccgccgcccctgttgcgatggcgcagaaaccccgttgacaaggcactgctttttcatgacgcaaaacgtcatattatttcacaaaaagcccagcgatttcacctgaagaagcttgggaactcctgccaaaaattgtagcacttctcacattgcaatgttgtcatggatgatgatgatgactcgtgtctccttgatcttattggagacccacaagcattgaactattttctacatggacctagtaataaatctagcaatgatgacttgactaatgcaggatattctgcagccaattcaaattcaattttcgccaactctagtaatgctgatcctaagtcatccctcaaaggtgtaagcaaccagcttggagaagggcccagtgatggactgccactttcaagtagcctccagtttcttgaagatgaactcgagtcttctcctcttcctgatctcactgaggaccaacctttcgacattcttcagaaatccttgcaagaggccaatatcactgaacagacattggcagaagaggcatatttggatgccagtataggttcaagccaacagtttgcacaagctcagcttcatccttcttcatcagcatcctttactcaggcttctaatgtttctaattactcaggtcagacgctgcagcctataggggtgacgcatgtgcctgttggagcatcgtttgcaagcaatacagtgggtgtacaacatggctttatgcaacatgtggggatcagtgttcccagccagcatttgtctaatagcagtcagattagtggttctggtcaaatacagttaattgggtcatttggtaatcatccttccatgatgactattaataacctagatggatctcaaatcatattaaagggcagcgggcagcaagccccatcaaatgtgagtggagggctcctggttcatagacagactcctaatggcaactccttgtttgggaactctagttccagtccagtagcacagcctgttaccgttccatttaacagcacaaattttcaaacatctttacctgtgcataacatcatcatacaaaggggtcttgcaccaaattcaaataaagtcccaattaatatacagccaaagcctatccagatgggtcagcaaaatacatacaatgtgaacaatttgggaattcagcagcaccacgtacaacaagggatctcttttgcttctgcaagctcaccccagggctcagtagttggtccacacatgtctgtgaacattgtaaaccaacagaacacaagaaagccagtcacctcacaggcagtgagcagcactgggggcagtattgttattcattcccccatgggccaacctcacgcaccccaaagtcagttccttatacctacaagcctttctgtcagttccaactcggtacaccacgtccagactataaatgggcaacttcttcaaactcaaccctctcagctcatttctggccaagtggcctcagagcatgtcatgttgaacagaaactcttccaacatgctcaggaccaaccaaccatatactggaccgatgcttaacaaccagaatactgctgtccacttagtgtctgggcagacatttgctgcctctggaagtccagtgatagccaatcatgcctctcctcagcttgtgggtggacagatgcccttgcagcaggcatccccaactgtattacacctgtcacctgggcagagcagcgtttcccaaggaagacctggcttcgccaccatgccatcggtgacaagcatgtcaggacctagtcggttccctgctgtcagctcagccagcactgcccatcctagtcttgggtctgcagttcagtctggttcatcaggatcaaactttacaggagatcagctgacccagccaaacaggactccagtaccagtcagtgtgtctcatcgtcttccagtttcttcttccaagtctaccagcaccttcagtaacacacctggaacaggaacccagcaacaattcttctgccaggctcagaaaaaatgtctgaatcagacttcccccatttctgctcccaagaccacagacggcctgaggcaagcacagatccctgggctcttgagcaccacactgccagggcaggattctggaagcaaagttatatccgcatccttaggaaccgcacaaccacagcaggaaaaagtagttggatcatctcctggccatccagctgtgcaggtggagagtcattcgggaggacaaaaaaggcctgctgcgaaacagctaacgaaaggagctttcattctccagcagttgcagagggaccaagcccacactgtgacaccagacaaaagtcacttccgatcactaagtgatgcggtacagagactgctctcctaccacgtgtgccagggctccatgcccactgaagaagacttgagaaaagtggacaatgaatttgagacagttgccactcagctcctaaaaaggacccaagctatgcttaacaaatacagatgcctgctcctagaagatgccatgcgaatcaatccctctgctgagatggtgatgatcgataggatgttcaaccaggaggaaagagcttccctgtcccgagacaagcgtttggcacttgtagaccctgagggttttcaggctgatttctgttgttccttcaaacttgataaagctgctcatgagacacagtttggccggagtgaccagcatggcagtaaagcaagcagctctctgcaaccgccagccaaggcccaaggcagagaccgagccaaaaccggtgtgacggaacccatgaatcatgaccagtttcatctagtgcctaatcacatcgtggtctctgcagaaggaaacatttctaaaaaaacagaatgccttggcagagcactgaaatttgacaaagtgggcttagtgcagtaccagagcacgtctgaagagaaggccagccggagagagcctctgaaggccagtcagtgctctcccggccctgaggggcaccggaaaacctcatccagatcggatcatggtactgagagcaaactgtcaagcatcctagcagattcgcacttggagatgacgtgtaacaattccttccaggacaaaagtctgaggaattctccaaagaatgaagttttacacacagacatcatgaaagggtcaggcgaaccccagccagatctccagctgacaaagagcttggaaaccacatttaagaacatcttggaactcaaaaaggcgggacggcagccccagagtgaccccacggttagcggctctgttgagttagatttccccaacttttctcctatggcttcacaggaaaactgcctggaaaagttcatcccggaccacagtgaaggtgttgtagaaactgactccattttagaagcagctgtaaatagtatcctagagtgttaatagcagcagtcctccccctaccccgccccgagaccccaccccgagaccccaccccggaccagttacattcgttcctggcaaaagcaaatggaaatggtctcctgtctccagcctgcttgatctttcatcacaggttattctttctaatctcaatcctgttctttgtttaagagcaatacttgtcgtgattacagggagatcctttagtaaaattaatccttggcagaaagcagtctgataggccccactcatttcaagtgttatgaaagtgcttataggcattttgtttatttgttttgttttttaaaaacactgtaactcaatgagaccacagtatacttggcccttggtaaaattttgacaatcataagtcatttgaaaagaacagacttactaaaatcaaacgagacggatagaagctactttttaaagaatatcccactgcatctgcaaatttagttttgggtttttttattattattattttgagtttttttgtgtgtgttttgttgttattgttgaggggaagaccacatggttcttccccctcagccatctttgagcagtaaattgctggctgtgctgccagggacccgcagccctggtggaaaagccagtagcacatacgcagggcattgcagggcttccctattgatggttcaagtgcttttctgatgcttccggagcaaaacctcatgcttttaggcatatctatgttgaatttcacctagggaatgttctgttcttagttacagcagcaaaatttgaaataatttcaccaggctaaataaaggaaaatggaaaccagttaagaggcacagtgtacagaggaggccgggatagagccatgagggttataatattaatatgtatatatgtaaaagcatatatatgttaactattgagaaaaaacaagttttgcattttataattggatatagtcaacatataatgtatgtttttgtttgttgctggattttgtttcatttaacctctctttgcaccctctcccacaacaaataccaagcatcaaaagcactttcatttgaaaattattatgttgtaatttttcagtttaaactttaaggagactctggccttgtttatgcttcttgtctgagaacagtagtgacccctggcagcaattcattaccaaaacacagacaaaccaaaggtaaccagctagcccaccactgaaaggaaagatctgagacatgggattcccatttgagagccaaaggatatgccctgtcatggtttctgtttggcctgtgttcatattagtgagcatggcttactgctttatttatttttatttcttgtcagggagtattctccgttttcctttctcgtatacctgccccaggttatcccatttctgttgttacctttattcttaatgtcattgtaaccatcacttatctcctctcattgggaaagctacatgatagtatttttatgcactcttctcccacacatacacacacgtgcatgtatctgagctgctcggatccagaggtcatttttgttacagtgtgtgcacactcactctccttcttagtgtgcatactctctcatttattctgtttatctccctggctctggaggtgcagccactggtcttcactttaatgtgttgccagaatctgcttctggctgtcgccaacatggggatgacccccattgtcatcatgttgggcatttcttttccagattggcctgtgatggaaaggaaggcttctaattagaaaacacagcaacagaagacctataccccggtgcccctgtgtcccactacacacagaaaaccctgtgagatggccagtcttcataatagcaacgtaccttcaccccagccacatgccccagccaatacaaattggaaaatctggcccattttagggttaccattttttccttatttgtgccaatgtccaagttgcagatttcccctttttcctgtattgtaacatattagataagttggtgtcgccagttggtactttctgtttgggtagtcctagggtaacaccctgccctaaactccatgatttcataggcttttcttcccttggggctcatgctcccctaattcctagcaagatgatccttcctaatcaaattcttctcattgcagaactttatccctggaagccttcatgtgggctgctagtgagttacattaattactgcaaatcagtggaattctcaagagacaagataagcttcatgtacatttgtcacctctctttcttccctatcctgccctgctgtcccaatcctagcttttctatataccatcctaaagggtttttaagccctaacacttgtctagcaaatggagagcctaatttaccaaaatgaaacttgtaaatttttgtgtcattgtatgtaagtttactttttatggaggaaggattctagataatgacaaatgaagattatgacatgtatttcactcctgtgattaggttctacgcacatgggtcataactcgcatgtcgagccccctctagtgaagggtaggagagctcagcctcggatggccaacattcagttgttcaggttcattcgtcaaagttaagttttagaactatttgtactcagtaacaaaaatcattttctttttttttttttttttctgttgtggaaaagcgtgaatttgttattaagcatttgattttctgtgtccttaagtacttcctgaagatgaagcaaaattttaatctggcaattatgaaaaagaaatattttagctctgaaggatttagtagattctgttagattagggaggccttacagactgactttacttaaagaggacgcgtcactcgctgtcagtgtggtgtgggctttatttgcttaaataccttcatttgtatagtacgtctcacttgaaattgctttgtatacattttgtaaaaatatttataaaatgttttgt

SEQ ID NO: 137193 - DNA, 799 bp, Homo sapiens
  Payload ID: 6860
  Gene Symbol: GCG
  Gene Name: glucagon
  Uniprot ID: P01275
  ENST ID: ENST00000375497
  CDS Start-End: 257-799
gcatagaatgcagatgagcaaagtgagtgggagagggaagtcatttgtaacaaaaactcattatttacagatgagaaatttatattgtcagcgtaatatctgtgaggctaaacagagctggagagtatataaaagcagtgcgccttggtgcagaagtacagagcttaggacacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataa

SEQ ID NO: 137194 - DNA, 1289 bp, Homo sapiens
  Payload ID: 6860
  Gene Symbol: GCG
  Gene Name: glucagon
  Uniprot ID: P01275
  ENST ID: ENST00000418842
  CDS Start-End: 256-798
catagaatgcagatgagcaaagtgagtgggagagggaagtcatttgtaacaaaaactcattatttacagatgagaaatttatattgtcagcgtaatatctgtgaggctaaacagagctggagagtatataaaagcagtgcgccttggtgcagaagtacagagcttaggacacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttctttaccatt

SEQ ID NO: 137195 - DNA, 2051 bp, Homo sapiens
  Payload ID: 6861
  Gene Symbol: GCGR
  Gene Name: glucagon receptor
  Uniprot ID: P47871
  ENST ID: ENST00000400723
  CDS Start-End: 294-1727
agtttgcaccgaccccgatctggcagcgccgcgaagacgagcggtcaccggcgcccgacccgagcgcgcccagaggacggcggggagccaagccgacccccgagcagcgccgcgcggaccctgaggctcagaggggcagcttcaggggaggacaccccactggccaggacgccccaggctctgctgctctgccactcagctgccctcggaggagcgtacacacccaccaggactgcattgccccagctgtgcagcccctgccagatgtgggaggcagctagctgcccagaggcatgcccccctgccagccacagcgacccctgctgctgttgctgctgctgctggcctgccagccacaggtcccctccgctcaggtgatggacttcctgtttgagaagtggaagctctacggtgaccagtgtcaccacaacctgagcctgctgccccctcccacggagctggtgtgcaacagaaccttcgacaagtattcctgctggccggacacccccgccaataccacggccaacatctcctgcccctggtacctgccttggcaccacaaagtgcaacaccgcttcgtgttcaagagatgcgggcccgacggtcagtgggtgcgtggaccccgggggcagccttggcgtgatgcctcccagtgccagatggatggcgaggagattgaggtccagaaggaggtggccaagatgtacagcagcttccaggtgatgtacacagtgggctacagcctgtccctgggggccctgctcctcgccttggccatcctggggggcctcagcaagctgcactgcacccgcaatgccatccacgcgaatctgtttgcgtccttcgtgctgaaagccagctccgtgctggtcattgatgggctgctcaggacccgctacagccagaaaattggcgacgacctcagtgtcagcacctggctcagtgatggagcggtggctggctgccgtgtggccgcggtgttcatgcaatatggcatcgtggccaactactgctggctgctggtggagggcctgtacctgcacaacctgctgggcctggccaccctccccgagaggagcttcttcagcctctacctgggcatcggctggggtgcccccatgctgttcgtcgtcccctgggcagtggtcaagtgtctgttcgagaacgtccagtgctggaccagcaatgacaacatgggcttctggtggatcctgcggttccccgtcttcctggccatcctgatcaacttcttcatcttcgtccgcatcgttcagctgctcgtggccaagctgcgggcacggcagatgcaccacacagactacaagttccggctggccaagtccacgctgaccctcatccctctgctgggcgtccacgaagtggtcttcgccttcgtgacggacgagcacgcccagggcaccctgcgctccgccaagctcttcttcgacctcttcctcagctccttccagggcctgctggtggctgtcctctactgcttcctcaacaaggaggtgcagtcggagctgcggcggcgttggcaccgctggcgcctgggcaaagtgctatgggaggagcggaacaccagcaaccacagggcctcatcttcgcccggccacggccctcccagcaaggagctgcagtttgggaggggtggtggcagccaggattcatctgcggagacccccttggctggtggcctccctagattggctgagagccccttctgaaccctgctgggaccccagctagggctggactctggcacccagagggcgtcgctggacaacccagaactggacgcccagctgaggctgggggcgggggagccaacagcagcccccacctaccccccacccccagtgtggctgtctgcgagattgggcctcctctccctgcacctgccttgtccctggtgcagaggtgagcagaggagtccagggcgggagtgggggctgtgccgtgaactgcgtgccagtgtccccacgtatgtcggcacgtcccatgtgcatggaaatgtcctccaacaataaagagctcaagtggtcaccgtg

SEQ ID NO: 137196 - DNA, 564 bp, Homo sapiens
  Payload ID: 6861
  Gene Symbol: GCGR
  Gene Name: glucagon receptor
  ENST ID: ENST00000573428
  CDS Start-End: 325-564
actaccttctctggtttcacaaaaacatcccggctcccatcccggagctcctcaaagcgtctgagaggccccttgcggacgccctgggagccccgctgccttcctggaccagtggccgctccacccatcctgggggcccagctccaggaccctgaggctcagaggggcagcttcaggggaggacaccccactggccaggacgccccaggctctgctgctctgccactcagctgccctcggaggagcgtacacacccaccaggactgcattgccccagctgtgcagcccctgccagatgtgggaggcagctagctgcccagaggcatgcccccctgccagccacagcgacccctgctgctgttgctgctgctgctggcctgccagccacaggtcccctccgctcaggtgatggacttcctgtttgagaagtggaagctctacggtgaccagtgtcaccacaacctgagcctgctgccccctcccacggagctggtgtgcaacagaaccttcgacaagtattcctgctggccggacacccccgccaataccacggccaacatctcc

SEQ ID NO: 137197 - DNA, 1872 bp, Homo sapiens
  Payload ID: 6861
  Gene Symbol: GCGR
  Gene Name: glucagon receptor
  ENST ID: ENST00000570996
  CDS Start-End: 279-1850
cgatctggcagcgccgcgaagacgagcggtcaccggcgcccgacccgagcgcgcccagaggacggcggggagccaagccgacccccgagcagcgccgcgcggaccctgaggctcagaggggcagcttcaggggaggacaccccactggccaggacgccccaggctctgctgctctgccactcagctgccctcggaggagcgtacacacccaccaggactgcattgccccagctgtgcagcccctgccagatgtgggaggcagctagctgcccagaggcatgcccccctgccagccacagcgacccctgctgctgttgctgctgctgctggcctgccagccacaggtcccctccgctcaggtgatggacttcctgtttgagaagtggaagctctacggtgaccagtgtcaccacaacctgagcctgctgccccctcccacggagctggtgtgcaacagaaccttcgacaagtattcctgctggccggacacccccgccaataccacggccaacatctcctgcccctggtacctgccttggcaccacaaagtgcaacaccgcttcgtgttcaagagatgcgggcccgacggtcagtgggtgcgtggaccccgggggcagccttggcgtgatgcctcccagtgccagatggatggcgaggagattgaggtccagaaggaggtggccaagatgtacagcagcttccaggtgatgtacacagtgggctacagcctgtccctgggggccctgctcctcgccttggccatcctggggggcctcagcaagctgcactgcacccgcaatgccatccacgcgaatctgtttgcgtccttcgtgctgaaagccagctccgtgctggtcattgatgggctgctcaggacccgctacagccagaaaattggcgacgacctcagtgtcagcacctggctcagtgatggagtgagcccccctcggcggccccaggcaggtgggtgggtgggcagccaggcaggtggccacgtagccgcgctcacactgcacctgtaccaggcggtggctggctgccgtgtggccgcggtgttcatgcaatatggcatcgtggccaactactgctggctgctggtggagggcctgtacctgcacaacctgctgggcctggccaccctccccgagaggagcttcttcagcctctacctgggcatcggctggggtgcccccatgctgttcgtcgtcccctgggcagtggtcaagtgtctgttcgagaacgtccagtgctggaccagcaatgacaacatgggcttctggtggatcctgcggttccccgtcttcctggccatcctgatcaacttcttcatcttcgtccgcatcgttcagctgctcgtggccaagctgcgggcacggcagatgcaccacacagactacaagttccggctggccaagtccacgctgaccctcatccctctgctgggcgtccacgaagtggtcttcgccttcgtgacggacgagcacgcccagggcaccctgcgctccgccaagctcttcttcgacctcttcctcagctccttccaggtgcccgcccgcccgccggctcccccgcccggggcgcagtgtgccacccctgaccaccctgtctctccagggcctgctggtggctgtcctctactgcttcctcaacaaggaggtgcagtcggagctgcggcggcgttggcaccgctggcgcctgggcaaagtgctatgggaggagcggaacaccagcaaccacagggcctcatcttcgcccggccacggccctcccagcaaggagctgcagtttgggaggggtggtggcagccaggattcatctgcggagacccccttggctggtggcctccctagattggctgagagccccttctga

SEQ ID NO: 137198 - DNA, 3105 bp, Homo sapiens
  Payload ID: 6862
  Gene Symbol: GLP1R
  Gene Name: glucagon-like peptide 1 receptor
  Uniprot ID: P43220
  ENST ID: ENST00000373256
  CDS Start-End: 44-1435
gttccgcaggtggcagcgatggcccagtcctgaactccccgccatggccggcgcccccggcccgctgcgccttgcgctgctgctgctcgggatggtgggcagggccggcccccgcccccagggtgccactgtgtccctctgggagacggtgcagaaatggcgagaataccgacgccagtgccagcgctccctgactgaggatccacctcctgccacagacttgttctgcaaccggaccttcgatgaatacgcctgctggccagatggggagccaggctcgttcgtgaatgtcagctgcccctggtacctgccctgggccagcagtgtgccgcagggccacgtgtaccggttctgcacagctgaaggcctctggctgcagaaggacaactccagcctgccctggagggacttgtcggagtgcgaggagtccaagcgaggggaaagaagctccccggaggagcagctcctgttcctctacatcatctacacggtgggctacgcactctccttctctgctctggttatcgcctctgcgatcctcctcggcttcagacacctgcactgcaccaggaactacatccacctgaacctgtttgcatccttcatcctgcgagcattgtccgtcttcatcaaggacgcagccctgaagtggatgtatagcacagccgcccagcagcaccagtgggatgggctcctctcctaccaggactctctgagctgccgcctggtgtttctgctcatgcagtactgtgtggcggccaattactactggctcttggtggagggcgtgtacctgtacacactgctggccttctcggtcttatctgagcaatggatcttcaggctctacgtgagcataggctggggtgttcccctgctgtttgttgtcccctggggcattgtcaagtacctctatgaggacgagggctgctggaccaggaactccaacatgaactactggctcattatccggctgcccattctctttgccattggggtgaacttcctcatctttgttcgggtcatctgcatcgtggtatccaaactgaaggccaatctcatgtgcaagacagacatcaaatgcagacttgccaagtccacgctgacactcatccccctgctggggactcatgaggtcatctttgcctttgtgatggacgagcacgcccgggggaccctgcgcttcatcaagctgtttacagagctctccttcacctccttccaggggctgatggtggccatattatactgctttgtcaacaatgaggtccagctggaatttcggaagagctgggagcgctggcggcttgagcacttgcacatccagagggacagcagcatgaagcccctcaagtgtcccaccagcagcctgagcagtggagccacggcgggcagcagcatgtacacagccacttgccaggcctcctgcagctgagactccagcgcctgccctccctggggtccttgctgcaggccgggtggccaatccaggtgggagagacactcccagggacaagggaaggaagggacacacacacacacacacacacacacacacacacacacatacatcctgctttccctccccaaacccatcagacaggtaaatgggcagtgcctcctgggaccatggacacattttctcctaggagaagcagcctcctaatttgatcacagtggcgagaggagaggaaaaacgatcgctgtgaaaatgaggaggattgcttcttgtgaaaccacaggcccttggggttcccccagacagagccgcaaatcaaccccagactcaaactcaaggtcaacggcttattagtgaaactggggcttgcaagaggaggtggttctgaaagtggctcttctaacctcagccaaacacagagcgggagtgacgggagcctcctctgcttgcatcacttggggtcaccaccctcccctgtcttctctcaaagggaagctgtttgtgtgtctgggttgcttatttccctcatcttgccccctcatctcactgcccagtttctttttgaggggctttgtttgggccactgccagcagctgtttctggaaatggctgtaggtggtgttgagaaagaatgagcattgagacggtgctcgcttctcctccaggtatttgagttgttttggtgcctgcctctgccatgcccagagaatcagggcaggcttgccaccggggaacccagccctggggtatgagctgccaagtctattttaaagacgctcaagaatcctctggggttcatctagggacacgttaggaatgtccagactgtgggtgtagattacctgccacttccaggagcccagagggccaagagagacattgcctccacctctccttggaaatactttatctgtgaccacacgctgtctcttgagaatttggatacactctctagctttaggggaccatgaagagactctcttagggaaaccaatagtccccatcagcaccatggaggcaggctccccctgcctttgaaattcccccacttgggagcttgtatatacttcactcacttttctttattgctgtgaatagtctgtgtgcacaatgggcaattctgacttctcccatctagtggaaatgagcgaaatcatggttgtagtgatgttgtttgggagagtgcagtagtaattgatttgacccactcacacttggagctaattaaggtttgccctgcctgcagcctcccccacaaataatgaacagcagaaagactggacggggaaacctatcaatcctgcccccagccatggtgaggaagccccaagccatggtgacacacagcagcactgcagatagccagacacatggctatcctagagaggctggcaaggagttcgtggctgcaaaagaagtttctggagcaagagagagctcgctcttgggagtcaggacctccggggagagcagagggttccgacggattcctttatgagtcagtctctctctcccttttaaatggtgggaaccctccccaaaacctttccccagacacattctcctgtgcccctcagagaggcatgtgatgtgcaaggaaaataataggatataaaacacatcaagtagaaaatttcttatacttc

SEQ ID NO: 137199 - DNA, 4572 bp, Homo sapiens
  Payload ID: 6863
  Gene Symbol: GLP2R
  Gene Name: glucagon-like peptide 2 receptor
  Uniprot ID: O95838
  ENST ID: ENST00000262441
  CDS Start-End: 514-2175
gaggagattttgcctttgtggttagcctcagcccagcctggacaagcttaatgccttagaaagaaataccctgcctcaaaaagacacctgcctctaaactggctcgagccccatcgccttctgccagccattcctctgtagctcgaaccccagcctgtctcagccagcttcgtgcattgagcagaaccttcagggtggagcccgctgaccgccttgttctttctcctcagcctgtcaaggaagtcccagaaagcacagctgacttagggaaggtctgggaaaaatctccctgcttttgggggggcaggggcgggggatgagccagggccgagaaggaactctgaagactccgtagattgctctagaccgcctcagacactctcggcgcagcgtggagaggatttgtgcaaacatttcctctgtggaccaagaggaatgcaagaggaggctgcctgcggtgcatcttggacggctagagagatgtacccctacttgtgaaggtgcacgaggaagatgaagctgggatcgagcagggcagggcctgggagaggaagcgcgggactcctgcctggcgtccacgagctgcccatgggcatccctgccccctgggggaccagtcctctctccttccacaggaagtgctctctctgggcccctgggaggcccttcctcactctggtcctgctggtttccatcaagcaagttacaggatccctccttgaggaaacgactcggaagtgggctcagtacaaacaggcatgtctgagagacttactcaaggaaccttctggcatattttgtaacgggacatttgatcagtacgtgtgttggcctcattcttctcctggaaatgtctctgtaccctgcccttcatacttaccttggtggagtgaagagagctcaggaagggcctacagacactgcttggctcaggggacttggcagacgatagagaacgccacggatatttggcaggatgactccgaatgctccgagaaccacagcttcaagcaaaacgtggatcgttatgccttgctgtcaaccttgcagctgatgtacaccgtgggatactccttctctcttatctccctcttcctggctctcaccctcctcttgtttcttcgaaaactccactgcacgcgcaactacatccacatgaacttgtttgcttctttcatcctgagaaccctggctgtactggtgaaggacgtcgtcttctacaactcttactccaagaggcctgacaatgagaatgggtggatgtcctacctgtcagagatgtccacctcctgccgctcagtccaggttctcttgcattactttgtgggtgccaattacttatggctgctggttgaaggcctctacctccacacgctgctggagcccacagtgcttcctgagaggcggctgtggcccagatacctgctgttgggttgggccttccctgtgctatttgttgtaccctggggtttcgcccgtgcacacctggagaacacagggtgctggacaacaaatgggaataagaaaatctggtggatcatccgaggacccatgatgctctgtgtaacagtcaatttcttcatcttcctgaaaattctcaagcttctcatttctaagctcaaagctcatcaaatgtgcttcagagattataaatacagattggcaaaatcaacactggtcctcattcctttattgggcgttcatgagatcctcttctctttcatcactgatgatcaagttgaaggatttgcaaaacttatacgacttttcattcagttgacactgagctcctttcatgggttcctggtggccttgcagtatggttttgccaatggagaggtgaaggctgagctgcggaaatactgggtccgcttcttgctagcccgccactcaggctgcagagcctgtgtcctggggaaggacttccggttcctaggaaaatgtcccaagaagctctcggaaggagatggcgctgagaagcttcggaagctgcagccctcacttaacagtgggcggctcctacatctagccatgcgaggtcttggggagctgggcgcccagccccaacaggaccatgcacgctggccccggggcagcagcctgtccgagtgcagtgagggggatgtcaccatggccaacaccatggaggagattctggaagagagtgagatctagggtggagttccaccaccctggctctgctcccagggactcttgagggggcccaggaagaggaagcaaagcaggacacacgttgctgggcacggaatcattctcgttccattcaccatgccactttgatatgaaagctatcacaaggttcttcaagctctgtatgaaagaggctgtgtgtcatgctcacagcctctgcctgctcttctcatcctaataacccccaccagtgtgttttccacaatgcccaccagaccctagggcctggctctaaattcaagccaatgaagtcccaccatgaagagaggtctcctgttatagagaagccagccaatatctcttcctttatcccttggggtgcatgctttccatctgaggttgggtttagggtgcgtgaaaacctcctaggaagcttttaaaatgcagaatcctagacttgtggctaagattctaagacagtgagtctgggaccatggccaggaattggagctgtttaataagcatcccaggtaattctgctgcaagcccacccttggagaacactgggcagggtgagagggagctagaagcgcccccatgtggccatggcaggatgctgcaagagacagtctgctctcccaggtcagctggggtgtgcctgccctccttggagagtatgtaactccacccaccagagtgccactcctctctgctcttcctctcctatcaagtcttgcctctctctctctttgcctcagttctctgtccctgcacagcaggagttctgcttgatcctccctttgaggattggccccagtgcctggggaccctctgaatgtcgtctttggtctgttcctctcctttctggctctatctacctttctgagtttggcttctaccagcctgatttacactaccattctcttggggcaaggaatgtccccaccatttttggtttgccattgatgcattgattgtcacacctgttgtcccaggaagttgacctataactctccatggccagagtccctgctgatcagaattcaatttgcccagtgggaataaatactgaaagcaggagggcccaggtaaagcaataggagtttggctggatctggacatgcccagggtggctctgagagatccaagactttgcatccaccagcctgtgggatctttcctgcctactgtgacccatggaggctgaggagggcccaggcagttggggtcaggctcaatgactgaaagtatagggcaagaggctgtaggaagatcaagggatggacatcctttggaaacagtgtgttaatgcacaggagtgtcactttcatggtatgtaaaatgcatgtgtacgtgggtggggtatgttgctatgggactaaataccaccttgtcttcgggggagtcagtttgatactcctcaagcagggctgccatatttagcaaacaaaaacaaggtactcaattaaatttgaatttcagacaaatagtcttcttgtataagtatatcccatgggcatatttaatctgagattggaattcaatcatgcatcttgtcttttactggcatctctgttttcaaggatactttgccacagggctgggactagggtgaaataatcaaggcactcatctctaaaaagctcaaagtaaatgatcaaaataaatcatattttaatgcaatattctaaaaaaacaaattaacaaactacagcccatgagccatttatagaaatgaaatttgattggagccaggggcaggataagggtgaggcaggagaggccagctcttgcaagtgcaggctctggtcctgactttcaaatgttgtctatgagggacttttaatgtgaatttttatttttagacaattgcattaaaatgttatttatattgactatggggacttttggggcccccttaaattttgcacttgaaatgggatccccacttgtgtcaccccatagtccagccctggttttaggatggggatggaggcaaaggcatcaggcaagtaatgaagcaaaggtttattttttggtgtccagattatccatagctcagtcatgaaaatctatgtctttctatttttctcctttctgcaaatgtccctgcctcggctcatcagccaattagctcctagaaagctggggtcatctcgtattcccagcaagtacccagcacagtgccggttcagagcaggtgctccacacacattcctggaatgagacagcacagaaatggctctcgggagcctcggatgctgctgggagtaagtgatccaggaccttaccgctaagaggagaaactttttttcaaagcatttataaatactccctccacccctcactccacaaatggggtgatcaacacttactgcttgctcttgttctgctaatgattaaaacaagtttatttaattt

SEQ ID NO: 137200 - DNA, 523 bp, Homo sapiens
  Payload ID: 6863
  Gene Symbol: GLP2R
  Gene Name: glucagon-like peptide 2 receptor
  ENST ID: ENST00000304773
  CDS Start-End: 169-523
ttactttcagagagctcaggaagggcctacagacactgcttggctcaggggacttggcagacgatagagaacgccacggatatttggcaggatgactccgaatgctccgagaaccacagcttcaagcaaaacgtggatcgttatgccttgctgtcaaccttgcagctgatgtacaccgtgggatactccttctctcttatctccctcttcctggctctcaccctcctcttgtttcttcgaaaactccactgcacgcgcaactacatccacatgaacttgtttgcttctttcatcctgagaaccctggctgtactggtgaaggacgtcgtcttctacaactcttactccaagaggcctgacaatgagaatgggtggatgtcctacctgtcagagatgtccacctcctgccgctcagtccaggttctcttgcattactttgtgggtgccaattacttatggctgctggttgaaggcctctacctccacacgctgctggagcccacagtgcttcctgagaggcggc

SEQ ID NO: 137201 - DNA, 2606 bp, Homo sapiens
  Payload ID: 6863
  Gene Symbol: GLP2R
  Gene Name: glucagon-like peptide 2 receptor
  ENST ID: ENST00000458005
  CDS Start-End: 161-442
agattgctctagaccgcctcagacactctcggcgcagcgtggagaggatttgtgcaaacatttcctctgtggaccaagaggaatgcaagaggaggctgcctgcggtgcatcttggacggctagagagatgtacccctacttgtgaaggtgcacgaggaagatgaagctgggatcgagcagggcagggcctgggagaggaagcgcgggactcctgcctggcgtccacgagctgcccatgggcatccctgccccctgggggaccagtcctctctccttccacaggaagtgctctctctgggcccctgggaggcccttcctcactctggtcctgctggtttccatcaagcaagttacaggatccctccttgaggaaacgactcggaagtgggctcagtacaaacaggcatgtctgagagacttactcaaggaaccttctggctgactcttcgggtgcagccacgtgcaccatgcccacctccaaaagaaaaaaagaagaaagtaccttggcccgttgcctctgagcctactgaggacaatccccggctccggctgctttcagatcattttattcagaggccttgagattgacaggacactgtgaactctccctgtctttcttcacccaaaggcagtcccaggcttcaagcccttcccagctccctttgaagacctcatgggcccaggcatattttgtaacgggacatttgatcagtacgtgtgttggcctcattcttctcctggaaatgtctctgtaccctgcccttcatacttaccttggtggagtgaagagagctcaggaagggcctacagacactgcttggctcaggggacttggcagacgatagagaacgccacggatatttggcaggatgactccgaatgctccgagaaccacagcttcaagcaaaacgtggatcgttatgccttgctgtcaaccttgcagctgatgtacaccgtgggatactccttctctcttatctccctcttcctggctctcaccctcctcttgtttcttcgaaaactccactgcacgcgcaactacatccacatgaacttgtttgcttctttcatcctgagaaccctggctgtactggtgaaggacgtcgtcttctacaactcttactccaagaggcctgacaatgagaatgggtggatgtcctacctgtcagagatgtccacctcctgccgctcagtccaggttctcttgcattactttgtgggtgccaattacttatggctgctggttgaaggcctctacctccacacgctgctggagcccacagtgcttcctgagaggcggctgtggcccagatacctgctgttgggttgggccttccctgtgctatttgttgtaccctggggtttcgcccgtgcacacctggagaacacagggtgctggacaacaaatgggaataagaaaatctggtggatcatccgaggacccatgatgctctgtgtaacagcacttggactagaggaaacgggcttgaagagaaatgggagcattccctttggtcacaaggaagacatttaaccatgaacttgtaaaacactgacatataccccagagaaaggcattagatcttcatgtctatcagtttacaagaagataatctgtcctgaacaataaggagctaaacctgctgccctcccaatctgcacagctctaggattctaggactctgtgcattggttctagggctccccagagagtggaatttatgtgtcccaccagacatggaagggaaaagaaaggccatgcagaaagaagtgaaagaggcaggctaggagtcaggagcctgggctctatgactgacttgtgatgtgtccttcagccaggtgagttggcctctctgggcctctgtttcttcatctatgaaatcagtcttgaactagaccagtggttttcaaccagaggagattctgacccctggggacatttggctgtgtctggagacatttttaattgtcataaattggggatggggataggaggagaatgttgctactggcatctagtgggtggaggtcagggatgctgctcaacaccctacaacacacagaaccacccccagaataaataattatcctgccccaaatattaagagtgccaacattgaaaaaccctggactagacagtagctgcacattaaaacaacctggggaggattaaaaaaatacccagcccagacttacccagactgatggaatcaaatctcctgccatgtagagcttccttagcactggaatctcattcagccactctcttgtatcttcctttagcattcattgagcaccttcactgggcttggcttggtgctaggttatttcagagtttctatcctcagggaattcagaatttaatagttatcattctgagactcatcagactatgactgaaccaatatctgccttcatttttggtcatatgaccacatgttgcaattttccactgatctgaatagacataaccccaactctaaaagagaattccttaaaccacaacgtggaaggaacctggattcctgaatgactgtatggagcagaactccctccactgcactagactgtgacataaccaataaaataaaataagataaaataaa

SEQ ID NO: 137202 - DNA, 1882 bp, Homo sapiens
  Payload ID: 6863
  Gene Symbol: GLP2R
  Gene Name: glucagon-like peptide 2 receptor
  ENST ID: ENST00000574745
  CDS Start-End: 432-1553
tgctgccacaccagatccagaggcacagagccggggcacgttcctgtcaagggtgctggccctgccattctccccaggaggttacaggatccctccttgaggaaacgactcggaagtgggctcagtacaaacaggcatgtctgagagacttactcaaggaaccttctggcatattttgtaacgggacatttgatcagtacgtgtgttggcctcattcttctcctggaaatgtctctgtaccctgcccttcatacttaccttggtggagtgaagagagctcaggaagggcctacagacactgcttggctcaggggacttggcagacgatagagaacgccacggatatttggcaggatgactccgaatgctccgagaaccacagcttcaagcaaaacgtggatcgttatgccttgctgtcaaccttgcagctgatgtacaccgtgggatactccttctctcttatctccctcttcctggctctcaccctcctcttgtttcttcgaaaactccactgcacgcgcaactacatccacatgaacttgtttgcttctttcatcctgagaaccctggctgtactggtgaaggacgtcgtcttctacaactcttactccaagaggcctgacaatgagaatgggtggatgtcctacctgtcagagatgtccacctcctgccgctcagtccaggttctcttgcattactttgtgggtgccaattacttatggctgctggttgaaggcctctacctccacacgctgctggagcccacagtgcttcctgagaggcggctgtggcccagatacctgctgttgggttgggccttccctgtgctatttgttgtaccctggggtttcgcccgtgcacacctggagaacacagggtgctggacaacaaatgggaataagaaaatctggtggatcatccgaggacccatgatgctctgtgtaacagtcaatttcttcatcttcctgaaaattctcaagcttctcatttctaagctcaaagctcatcaaatgtgcttcagagattataaatacagattggcaaaatcaacactggtcctcattcctttattgggcgttcatgagatcctcttctctttcatcactgatgatcaagttgaaggatttgcaaaacttatacgacttttcattcagttgacactgagctcctttcatgggttcctggtggccttgcagtatggttttgccaatggagaggtgaaggctgagctgcggaaatactgggtccgcttcttgctagcccgccactcaggctgcagagcctgtgtcctggggaaggacttccggttcctaggaaaatgtcccaagaagctctcggaaggagatggcgctgagaagcttcggaagctgcagccctcacttaacagtgggcggctcctacatctagccatgcgaggtcttggggagctgggcgcccagccccaacaggaccatgcacgctggccccggggcagcagcctgtccgagtgcagtgagggggatgtcaccatggccaacaccatggaggagattctggaagagagtgagatctagggtggagttccaccaccctggctctgctcccagggactcttgagggggcccaggaagaggaagcaaagcaggacacacgttgctgggcacggaatcattctcgttccattcaccatgccactttgatatgaaagctatcacaaggttcttcaagctctgtatgaaagaggctgtgtgtcatgctcacagcctctgcctgctcttctcatcctaataacccccaccagtgtgttttccacaatgcccaccagaccctagggcctggctctaaattcaagccaatgaagtcccaccatgaagagaggtctcctgttatagagaagccagcc

SEQ ID NO: 137203 - DNA, 3461 bp, Homo sapiens
  Payload ID: 6864
  Gene Symbol: GBE1
  Gene Name: glucan (1,4-alpha-), branching enzyme 1
  Uniprot ID: Q04446
  ENST ID: ENST00000429644
  CDS Start-End: 645-2753
aaacttaggagagtcctggttgtaagaggtattaacattttcagcagtagtactctagctacacttgactgttcccctctctgtgaatttacatgatatgtttgaaatactgcccctcaaaagtctcagaactttgagaaatacggtcctttccaaaaaaaccccttatgtccaatttgaaggggtcgctgtcagtgggtgcttaagtgggtaaagaaaagccaagaatatgtcagggtgaggaaggccaaggctgagcgaggtcagcttgggacccacctcctagaatgacctccgccagcaggaaaaaaccgttaaggggaggaaagggcaggtccctgcggcctccaggtgccagccgcgtgagtgggcggagaggcctcggtgcctcctacccgctccggacgtgcgtcccggcatcaccccgggatccgctcctccccgctggcggggggagaaagggcaggaggccttccgtcccggctataaagggccccggaccgccgcggctcgcctcggcttgcctcgacacgcctaggcgccctccggctccgccctagccgccgcgtcccagctagagctccagcgcccgctcaggccccactcgacctctcgggcctcggctacttggactgcggcggaatatggcggctccgatgactcccgcggctcggcccgaggactacgaggcggcgctcaatgccgccctggctgacgtgcccgaactggccagactcctggagatcgacccgtacttgaagccctacgccgtggacttccagcgcaggtataagcagtttagccaaattttgaagaacattggagaaaatgaaggtggtattgataagttttccagaggctatgaatcatttggcgtccacagatgtgctgatggtggtttatactgcaaagaatgggccccgggagcagaaggagtttttcttactggagattttaatggttggaatccattttcgtacccatacaaaaaactggattatggaaaatgggagctgtatatcccaccaaagcagaataaatctgtactcgtgcctcatggatccaaattaaaggtagttattactagtaaaagcggagagatcttgtatcgtatttcaccgtgggcaaagtatgtggttcgtgaaggtgataatgtgaattatgattggatacactgggatccagaacactcatatgagtttaagcattccagaccaaagaagccacggagtctaagaatttatgaatctcatgtgggaatttcttcccatgaaggaaaagtagcttcttataaacattttacatgcaatgtactaccaagaatcaaaggccttggatacaactgcattcagttgatggcaatcatggagcatgcttactatgccagctttggttaccaaatcacaagcttctttgcagcttccagccgttatggaacacctgaagagctacaagaactggtagacacagctcattccatgggtatcatagtcctcttagatgtggtacacagccatgcttcaaaaaattcagcagatggattgaatatgtttgatgggacagattcctgttattttcattctggacctagagggactcatgatctttgggatagcagattgtttgcctactccagctgggaaattttaagattccttctgtcaaacataagatggtggttggaagaatatcgctttgatggatttcgttttgatggtgttacgtccatgctttatcatcaccatggagtgggtcaaggtttctcaggtgattacagtgaatatttcggactacaagtagatgaagatgccttgacttacctcatgttggcaaatcatttggttcacacgctgtgtcccgattctataacaatagctgaggatgtatcaggaatgccagctctgtgctctccaatttcccagggagggggtggttttgactatcgactagccatggcaattccagataagtggattcagctacttaaagagtttaaagatgaagactggaacatgggcgatatagtatacacgctcacaaacaggcgctaccttgaaaagtgcattgcttatgcagagagccatgatcaggcattggttggggataagtcgctggcattttggttgatggatgccgaaatgtatacaaacatgagtgtcctgactccttttactccagttattgatcgtggaatacagcttcataaaatgattcgactcattacgcatgggcttggtggagaaggctatctcaatttcatgggtaatgaatttgggcatcctgaatggttagacttcccaagaaaaggaaataatgagagttaccattatgccaggcggcagtttcatttaactgacgacgaccttcttcgctacaagttcctaaataattttgacagggatatgaatagattggaagaaagatatggttggcttgcagctccacaggcctacgtgagtgaaaaacatgaaggcaataagatcattgcttttgaaagagcaggtcttcttttcattttcaacttccatccaagcaagagctacactgactaccgagttggaacagcattgccagggaaattcaaaattgtgctagattcagatgcagcggaatatggagggcatcagagactggaccacagcactgactttttttctgaggcttttgaacataatgggcgtccctattctcttttggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaattgc

SEQ ID NO: 137204 - DNA, 2513 bp, Homo sapiens
  Payload ID: 6864
  Gene Symbol: GBE1
  Gene Name: glucan (1,4-alpha-), branching enzyme 1
  ENST ID: ENST00000489715
  CDS Start-End: 54-2039
aatttcacttggattcggcccagattaacagctgtttctaacttcgttgtcccatgaatcttgctaaagtgaggtataagcagtttagccaaattttgaagaacattggagaaaatgaaggtggtattgataagttttccagaggctatgaatcatttggcgtccacagatgtgctgatggtggtttatactgcaaagaatgggccccgggagcagaaggagtttttcttactggagattttaatggttggaatccattttcgtacccatacaaaaaactggattatggaaaatgggagctgtatatcccaccaaagcagaataaatctgtactcgtgcctcatggatccaaattaaaggtagttattactagtaaaagcggagagatcttgtatcgtatttcaccgtgggcaaagtatgtggttcgtgaaggtgataatgtgaattatgattggatacactgggatccagaacactcatatgagtttaagcattccagaccaaagaagccacggagtctaagaatttatgaatctcatgtgggaatttcttcccatgaaggaaaagtagcttcttataaacattttacatgcaatgtactaccaagaatcaaaggccttggatacaactgcattcagttgatggcaatcatggagcatgcttactatgccagctttggttaccaaatcacaagcttctttgcagcttccagccgttatggaacacctgaagagctacaagaactggtagacacagctcattccatgggtatcatagtcctcttagatgtggtacacagccatgcttcaaaaaattcagcagatggattgaatatgtttgatgggacagattcctgttattttcattctggacctagagggactcatgatctttgggatagcagattgtttgcctactccagctgggaaattttaagattccttctgtcaaacataagatggtggttggaagaatatcgctttgatggatttcgttttgatggtgttacgtccatgctttatcatcaccatggagtgggtcaaggtttctcaggtgattacagtgaatatttcggactacaagtagatgaagatgccttgacttacctcatgttggcaaatcatttggttcacacgctgtgtcccgattctataacaatagctgaggatgtatcaggaatgccagctctgtgctctccaatttcccagggagggggtggttttgactatcgactagccatggcaattccagataagtggattcagctacttaaagagtttaaagatgaagactggaacatgggcgatatagtatacacgctcacaaacaggcgctaccttgaaaagtgcattgcttatgcagagagccatgatcaggcattggttggggataagtcgctggcattttggttgatggatgccgaaatgtatacaaacatgagtgtcctgactccttttactccagttattgatcgtggaatacagcttcataaaatgattcgactcattacgcatgggcttggtggagaaggctatctcaatttcatgggtaatgaatttgggcatcctgaatggttagacttcccaagaaaaggaaataatgagagttaccattatgccaggcggcagtttcatttaactgacgacgaccttcttcgctacaagttcctaaataattttgacagggatatgaatagattggaagaaagatatggttggcttgcagctccacaggcctacgtgagtgaaaaacatgaaggcaataagatcattgcttttgaaagagcaggtcttcttttcattttcaacttccatccaagcaagagctacactgactaccgagttggaacagcattgccagggaaattcaaaattgtgctagattcagatgcagcggaatatggagggcatcagagactggaccacagcactgactttttttctgaggcttttgaacataatgggcgtccctattctcttttggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagatgggagaatatgtttaaaatattaggaatcctagaccatattttcaagtcatcttagcagctaggattctcaaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttaga

SEQ ID NO: 137205 - DNA, 4743 bp, Homo sapiens
  Payload ID: 6865
  Gene Symbol: GLCCI1
  Gene Name: glucocorticoid induced 1
  Uniprot ID: Q86VQ1
  ENST ID: ENST00000223145
  CDS Start-End: 558-2201
ttagttgccattcggagtgaggagtgggtagaagcggcggcggcggcggcggcgtttgcggtggcgcggactccgaggagcgccagcacctcgaggccctttctctctaccctggtccccagaagcaggggtcccggccctccttgcagctgccgggttctcccgtgcgtgcagccctgcgagggctgaggagaaggctgcgagcggccctcggggctgcgtgatccgggccgttgccctgtcagcacgatgcctggagcggtggcggcggcggctccgggctccttgcggccccggccgtgaccgccacaccgagcccagccgggcggttgcggccgttggacgtttgttttcgcagccttcccctcccccctcgccgaggcggcgggggtgtgcgttggggagggggagccccgagactcctcccccacagcgatacccccgcccctcccccttacacactcgcacgcactatcgcgccggctcccacacgctcgcgcgcctcccgccccgcgcctccgtgtcggccggcggcgtccagggcccgcagagccaccatgtccactgcctcctcctcctcctcctccagttcctctcagacccctcatcccccgtcgcagaggatgaggcgcagcgccgcggggtccccgcccgccgtcgccgccgccgggagcgggaacggtgcgggcggcggcggcggcgtgggctgcgccccggctgcgggagccggccggctgctgcagcccatccgcgccacggtgccctaccagctcttgcggggcagccagcacagtcccacgcgtccgcccgtcgccgctgccgccgcctcgctgggcagcctcccggggcccggcgcggcccgcggccccagcccgtccagcccgacgccgccggcggccgcagccccggccgagcaggcgccgcgggccaagggccgcccgagacggtccccagagagccaccggaggagcagctcacctgagagacggagccccggctcgcccgtgtgcagagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcagacacctagctgttgggcagaagagggtgcagaaaagaggtcacatcagcgttctgcgtcatgggggagtgctgatcaactaaaagagcagatcgccaaactgaggcagcaactacaacgcagtaaacagagtagtcgtcacagtaaggagaaagatcgccagtcacctcttcatggcaaccatataacaatcagtcacactcaggctactggatcaaggtcagttcctatgccactgtcaaatatatcagtgccaaaatcatctgtttcgcgtgtgccctgcaatgtagaaggaataagtcctgaattagaaaaggtattcattaaagaaaataatgggaaggaagaagtatccaagccgttggacataccagatggtcgaagagctccacttcctgctcattaccggagcagtagtactcgcagcattgacactcagactccttctgtccaggagcgcagcagtagctgcagcagtcattcaccctgtgtctcccctttttgtcccccggaatcccaggatggtagcccttgctcaacagaagatttgctctatgatcgtgataaagacagtgggagtagctcaccgttacccaagtatgcttcatctcccaaaccaaacaacagctacatgttcaaacgggagcccccagagggatgtgagcgagtgaaggtctttgaggaaatggcgtctcgtcagcctatctcggcccctctcttttcatgtcctgacaaaaacaaggttaatttcatcccaaccggatcagctttctgtcctgtaaaacttctaggccccctcttacctgcttctgaccttatgctcaagaactcccctaactctggccagagctcagctttggcaactctgaccgttgagcagctctcatcccgggtttcctttacgtctctttctgatgacaccagcacagcgggctccatggaggcctctgtccagcagccatcccagcagcagcagctcctgcaggaactgcagggtgaggaccacatctctgctcagaactatgtgatcatctaaaaaagggggagctggcctccaccctatgttccatggattcggaacaagatttcagacatctgcatgagtgacaaactttctgaacaccaccaccaccaataatacttatcagcatcataaagtatctcttaaacactgatcttggcagggacggaactcctattcagcagtttttgtggaaagcagtaatgcttgcaaaacgtgtgtgtcattcagcattttaagtggagactatgcatttcatagtatatttgacagattagtactgtgtcctgtgttttgttccagattcttcagtataaataagctctatatcaaaaagttgcctgtctaaatagaaaatgtcttgctgtgttttgtcctatggaaaatactgtaattcaggattatgtttacaattgatccaggtgtttgtttctaacttctgtaatacatacaatgcaaaaaaaaaaaaaaaaaaatggccacaacagttgcacagtgcccaccctatggcctagcttcaggtacttcagttgaagtctaaactcaggtaacttggaatgtatatcatattgggatattaaatatttcacagctaaaaagctaaagagggaacatcactcttttgcctttccttattttatgcatttccctttcctcattacattccacattcttagaataagaagtgcattcaatcctaggagaatgataatcctggacatgggtgaacatgaggagaaccagcaaaatctgtggtgtttgacatcactttgtcatgtggttacaagtaaaacaactgttgcattcactgtttcaacatgtgtacatgtggcttttttaaaagttcaggtgttgctcagtaaaggactgtgacaatgttgcaaataaagtgttcagtactggactgtacataaacattccacattgtgtgtgatgaaatttaaagacaagaatgtctagagttaatttcaaaataagtgaagtgtttgacggaatggttgagatttttttgtttatgttagccatcagggtcataactgttaccattttatctaaagacatatttatatttagtttctcccttggaaattctttattttgcaggtgaaaaagtgacatactttttgttattgtcttcctcaagcagtttaggtgcatgatcttcatttacatagaatacttgggtctcagaattgatgcaacataagcaggtttttttggtgacttacaagagcaatagtttgaagctatctcatttaagcctctcataatgcataatcatgagtagttttgaaatttgcaacctgtgaggtagagcataaactcaagaaaatagccttgaacttgcagacttttgacacaagttctccacaaagtgtgaagagagccccaggcattcctgattggtcaatgggagagcctaactttcattgttttcttcagtacaaagagtatccaaaagctaagtttttgtattccactactttcagttcaataaaacctagagttgtttcatctgcgcctaaagtgtatggcacaattttcttaagaattaggggaaccaggtgcctacagttaaaggaacgtttcagttcctttcattcattcctgggtttttcttttattttctaagaaggttgaagaaggatgagtgatagagaagaaagcaacaccattgatttttttttttaagaaatgatatatatatgtatatgtttgtgtgtgtgtgtgtgtgtgtgtgtgtgtgtattctgtgcattattttgtcatgatctcaattctcttctttccaccaaagtttgtcgtaatattttctcctgaaggtgcattctggctcctttaaattagtcagtgttatattgtaggagactgtcatggaaaaaaggactcagtttactttcgtcattttcacaggggaaccttttaaaacaatcttttcagcagcagatacctttaaccctaataatctcaggccttgatgaaaatactatattttgtagattatggttaaagggggaaaattactagttccgtaagataaatatgagctccatttgacttctgatgtctggtttagcattacataatatgttgatcttacactctgcttttgtccaaataaaatgcaatagtatcaatatcaatttcagaaaaatggactgaatatgcttttttggtgatgaaatctcatgtacgatatttatagtgatgtgcttttattttctcatgagatactaaatattaattgtgttgtacatttgttcttagcatatattaaagttttgaaccaaatgtgttaaagcttacgctttgccatgtaaatttcccagaagttgttgagctcaaatgtatcctacatccagctgtagaaatttgtcagaaattgtttaaattttgtatataattgtactgtttaattctagccattgcgctgaacagtatttgagttaccatataatatggctttacacaaggaaatgtgtggcttttgttttgtattttttcagtatagaagttcctgtgtcttatttaaataaagttattagtaaaactgaaa

SEQ ID NO: 137206 - DNA, 873 bp, Homo sapiens
  Payload ID: 6865
  Gene Symbol: GLCCI1
  Gene Name: glucocorticoid induced 1
  ENST ID: ENST00000438949
  CDS Start-End: 1-574
gtcacctcttcatggcaaccatataacaatcagtcacactcaggctactggatcaaggtcagttcctatgccactgtcaaatatatcagtgccaaaatcatctgtttcgcgtgtgccctgcaatgtagaaggaataagtcctgaattagaaaaggtattcattaaagaaaataatgggaaggaagaagtatccaagccgttggacataccagatggtcgaagagctccacttcctgctcattaccggagcagtagtactcgcagcattgacactcagactccttctgtccaggagcgcagcagtagctgcagcagtcattcaccctgtgtctcccctttttgtcccccggaatcccaggatggtagcccttgctcaacagaagatttgctctatgatcgtgataaagacagtgggagtagctcaccgttacccaagtatgcttcatctcccaaaccaaacaacagctacatgttcaaacgggagcccccagagggatgtgagcgagtgaaggtctttgaggaaatggcacaaacacctggtgtggtttctctctcctgcttcccttcccagtgaccactctgcagcaagccccgggagctttgtatgaagaagctattccttttcaaatccctaaccctttctcctgattgctcctccaaatctgtggccagtgcagcaagtcctgtgaagacagtaaggaggtagcaggaggaggctaaaaatggtgacatcaaggaatagaaactggtggcttaagagaaggcttggtagagtgaactttggctcggtgggagaatcctaacatggcatagtttcaagctttatctcccttcccagaaagaaaacggtcccaacatcctcacactgtaagg

SEQ ID NO: 137207 - DNA, 581 bp, Homo sapiens
  Payload ID: 6865
  Gene Symbol: GLCCI1
  Gene Name: glucocorticoid induced 1
  ENST ID: ENST00000430798
  CDS Start-End: 1-581
gcggccgcagccccggccgagcaggcgccgcgggccaagggccgcccgagacggtccccagagagccaccggaggagcagctcacctgagagacggagccccggctcgcccgtgtgcagagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcagacacctagctgttgggcagaagagggtgcagaaaagaggtcacatcagcgttctgcgtcatgggggagtgctgatcaactaaaagagcagatcgccaaactgaggcagcaactacaacgcagtaaacagagtagtcgtcacagtaaggagaaagatcgccagtcacctcttcatggcaaccatataacaatcagtcacactcaggctactggatcaagccgttggacataccagatggtcgaagagctccacttcctgctcattaccggagcagtagtactcgcagcattgacactcagactccttct

SEQ ID NO: 137208 - DNA, 575 bp, Homo sapiens
  Payload ID: 6865
  Gene Symbol: GLCCI1
  Gene Name: glucocorticoid induced 1
  ENST ID: ENST00000414914
  CDS Start-End: 1-575
gcggccgcagccccggccgagcaggcgccgcgggccaagggccgcccgagacggtccccagagagccaccggaggagcagctcacctgagagacggagccccggctcgcccgtgtgcagagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcagatcgccaaactgaggcagcaactacaacgcagtaaacagagtagtcgtcacagtaaggagaaagatcgccagtcacctcttcatggcaaccatataacaatcagtcacactcaggctactggatcaaggtcagttcctatgccactgtcaaatatatcagtgccaaaatcatctgtttcgcgtgtgccctgcaatgtagaaggaataagtcctgaattagaaaaggtattcattaaagaaaataatgggaaggaagaagtatccaagccgttggacataccagatggtcgaagagctccact

SEQ ID NO: 137209 - DNA, 1912 bp, Homo sapiens
  Payload ID: 6866
  Gene Symbol: GMEB1
  Gene Name: glucocorticoid modulatory element binding protein 1
  Uniprot ID: Q9Y692
  ENST ID: ENST00000294409
  CDS Start-End: 91-1812
gcgcatgctccgtcgcctgcccgccctggccgctcgccgcccgcccgcccgacggagacgcagtcccagctatctgacttcatgtgaaagatggctaatgcagaagtgagtgtcccagtgggggatgtggttgtggtacctactgaaggaaatgaaggggagaatcctgaagacactaaaacccaagtgattttgcagttacagcctgtgcaacaaggtttgtttatcgatggacacttttacaacaggatttatgaagctgggtcggagaacaacacggcagttgtagcagtagaaactcacacgatacacaaaattgaagaagggattgatacaggcactatagaagcaaatgaggatatggaaattgcttaccccataacttgtggggagagcaaagccatcctcctctggaagaagtttgtatgtccaggaataaacgtgaagtgtgtcaagttcaatgatcagttgatcagccccaagcactttgttcatctggctggcaagtccactctgaaggactggaagagagctattcgtctgggtgggatcatgctcaggaaaatgatggactccggacagattgatttttaccaacatgacaaagtttgctccaatacctgcagaagcaccaaatttgatcttctgatcagcagtgcaagagctccagtgccaggacagcagacaagtgtggtgcagacacccacttcggctgatggtagcatcacgcagattgccatctcagaagagagcatggaagaggcagggctggaatggaactcagctctcaccgctgctgtcaccatggccacggaggagggtgtaaagaaagactcagaggaaatttcagaggacactttgatgttctggaaaggaatagctgatgtagggctgatggaagaggttgtctgcaatatacagaaggaaatagaggagctactcaggggagttcagcagcggctcatccaggctcccttccaagtcacagatgctgctgttctcaacaatgtagcacacacatttggcctaatggacacagtcaagaaggttttagacaacagaaggaaccaagtagagcagggagaagaacagtttctctatactctgacagacttggaacgccagttggaggagcagaagaagcaaggccaggatcacaggctgaaatctcagacagttcaaaatgtggtactgatgcctgtgagcactcctaagcctccaaaaaggccccggctccagcggccagcctccaccactgtcttgagcccttctcctcctgtccagcagcctcagttcacagtcatctcacccatcaccatcaccccagtgggtcagtcattttccatgggcaatattccagtggccaccctcagccagggctccagtcctgtgactgtccacacactgccttctggccctcagctcttccgctatgccacagtggtctcctctgccaagagcagctcaccagacacagtgaccatccacccttcatctagcttggcgctgctgagctctactgccatgcaggatgggagtacactgggcaacatgaccaccatggttagccctgtggaattggtggccatggagtccggcctaacctcggcaattcaggctgttgaaagcacctcagaggatgggcagaccatcattgagattgatccagccccggacccagaagctgaagatactgagggcaaagcagtcatcttggagacagagctgaggactgaggagaaagttgtggctgagatggaagaacaccagcatcaagttcacaatgtggagattgtggtcttagaggattaactggggatctcagggccaggagttatgttttgatttggaattttaattatttgtttatttttatcattgtcccactcatttccacataggaccctttttt

SEQ ID NO: 137210 - DNA, 1894 bp, Homo sapiens
  Payload ID: 6866
  Gene Symbol: GMEB1
  Gene Name: glucocorticoid modulatory element binding protein 1
  Uniprot ID: Q9Y692
  ENST ID: ENST00000361872
  CDS Start-End: 90-1781
ctgcgcatgctccgtcgcctgcccgccctggccgctcgccgcccgcccgcccgacggagacgtcccagctatctgacttcatgtgaaagatggctaatgcagaagtgagtgtcccagtgggggatgtggttgtggtacctactgaaggaaatgaaggggagaatcctgaagacactaaaacccaagtgattttgcagttacagcctgtgcaacaagggatttatgaagctgggtcggagaacaacacggcagttgtagcagtagaaactcacacgatacacaaaattgaagaagggattgatacaggcactatagaagcaaatgaggatatggaaattgcttaccccataacttgtggggagagcaaagccatcctcctctggaagaagtttgtatgtccaggaataaacgtgaagtgtgtcaagttcaatgatcagttgatcagccccaagcactttgttcatctggctggcaagtccactctgaaggactggaagagagctattcgtctgggtgggatcatgctcaggaaaatgatggactccggacagattgatttttaccaacatgacaaagtttgctccaatacctgcagaagcaccaaatttgatcttctgatcagcagtgcaagagctccagtgccaggacagcagacaagtgtggtgcagacacccacttcggctgatggtagcatcacgcagattgccatctcagaagagagcatggaagaggcagggctggaatggaactcagctctcaccgctgctgtcaccatggccacggaggagggtgtaaagaaagactcagaggaaatttcagaggacactttgatgttctggaaaggaatagctgatgtagggctgatggaagaggttgtctgcaatatacagaaggaaatagaggagctactcaggggagttcagcagcggctcatccaggctcccttccaagtcacagatgctgctgttctcaacaatgtagcacacacatttggcctaatggacacagtcaagaaggttttagacaacagaaggaaccaagtagagcagggagaagaacagtttctctatactctgacagacttggaacgccagttggaggagcagaagaagcaaggccaggatcacaggctgaaatctcagacagttcaaaatgtggtactgatgcctgtgagcactcctaagcctccaaaaaggccccggctccagcggccagcctccaccactgtcttgagcccttctcctcctgtccagcagcctcagttcacagtcatctcacccatcaccatcaccccagtgggtcagtcattttccatgggcaatattccagtggccaccctcagccagggctccagtcctgtgactgtccacacactgccttctggccctcagctcttccgctatgccacagtggtctcctctgccaagagcagctcaccagacacagtgaccatccacccttcatctagcttggcgctgctgagctctactgccatgcaggatgggagtacactgggcaacatgaccaccatggttagccctgtggaattggtggccatggagtccggcctaacctcggcaattcaggctgttgaaagcacctcagaggatgggcagaccatcattgagattgatccagccccggacccagaagctgaagatactgagggcaaagcagtcatcttggagacagagctgaggactgaggagaaagttgtggctgagatggaagaacaccagcatcaagttcacaatgtggagattgtggtcttagaggattaactggggatctcagggccaggagttatgttttgatttggaattttaattatttgtttatttttatcattgtcccactcatttccacataggacccttttttaaaaaaaaaaaaa

SEQ ID NO: 137211 - DNA, 6410 bp, Homo sapiens
  Payload ID: 6866
  Gene Symbol: GMEB1
  Gene Name: glucocorticoid modulatory element binding protein 1
  Uniprot ID: Q9Y692
  ENST ID: ENST00000373816
  CDS Start-End: 139-1830
aagcccggcctggcggcggcggtggcggtagctgccgtggcggcctctgcgcatgctccgtcgcctgcccgccctggccgctcgccgcccgcccgcccgacggagacgcagtcccagctatctgacttcatgtgaaagatggctaatgcagaagtgagtgtcccagtgggggatgtggttgtggtacctactgaaggaaatgaaggggagaatcctgaagacactaaaacccaagtgattttgcagttacagcctgtgcaacaagggatttatgaagctgggtcggagaacaacacggcagttgtagcagtagaaactcacacgatacacaaaattgaagaagggattgatacaggcactatagaagcaaatgaggatatggaaattgcttaccccataacttgtggggagagcaaagccatcctcctctggaagaagtttgtatgtccaggaataaacgtgaagtgtgtcaagttcaatgatcagttgatcagccccaagcactttgttcatctggctggcaagtccactctgaaggactggaagagagctattcgtctgggtgggatcatgctcaggaaaatgatggactccggacagattgatttttaccaacatgacaaagtttgctccaatacctgcagaagcaccaaatttgatcttctgatcagcagtgcaagagctccagtgccaggacagcagacaagtgtggtgcagacacccacttcggctgatggtagcatcacgcagattgccatctcagaagagagcatggaagaggcagggctggaatggaactcagctctcaccgctgctgtcaccatggccacggaggagggtgtaaagaaagactcagaggaaatttcagaggacactttgatgttctggaaaggaatagctgatgtagggctgatggaagaggttgtctgcaatatacagaaggaaatagaggagctactcaggggagttcagcagcggctcatccaggctcccttccaagtcacagatgctgctgttctcaacaatgtagcacacacatttggcctaatggacacagtcaagaaggttttagacaacagaaggaaccaagtagagcagggagaagaacagtttctctatactctgacagacttggaacgccagttggaggagcagaagaagcaaggccaggatcacaggctgaaatctcagacagttcaaaatgtggtactgatgcctgtgagcactcctaagcctccaaaaaggccccggctccagcggccagcctccaccactgtcttgagcccttctcctcctgtccagcagcctcagttcacagtcatctcacccatcaccatcaccccagtgggtcagtcattttccatgggcaatattccagtggccaccctcagccagggctccagtcctgtgactgtccacacactgccttctggccctcagctcttccgctatgccacagtggtctcctctgccaagagcagctcaccagacacagtgaccatccacccttcatctagcttggcgctgctgagctctactgccatgcaggatgggagtacactgggcaacatgaccaccatggttagccctgtggaattggtggccatggagtccggcctaacctcggcaattcaggctgttgaaagcacctcagaggatgggcagaccatcattgagattgatccagccccggacccagaagctgaagatactgagggcaaagcagtcatcttggagacagagctgaggactgaggagaaagttgtggctgagatggaagaacaccagcatcaagttcacaatgtggagattgtggtcttagaggattaactggggatctcagggccaggagttatgttttgatttggaattttaattatttgtttatttttatcattgtcccactcatttccacataggacccttttttaaaaaaaaaaaaacaaaatcttattgttgtaactgaaaatgttgggttcttcccactccctcattgaaaaatggacaaaacaagctgcccttccagaagttgagagtaggtcattcaatgtcctaatcatcttacaccaagaaagtaatttcttttaggggaagtgtcaagataacaagtaaccctgtccagaaagccatttccaggctcgtctgtgtgtgtaggcatgtggttttattcttgtaaagatgcattgaccaaactctggaacacagatctgacactggaaggcaacccactcgcatgtggatgctgaagggcactttattttgtatcctgaaaagggcctacagaggccagtacaaaactctcaaacaaaaggaagttgactctgctttgaggggaaggtggcatgccagcactagcttaaaaagggaagtgctagccgggcgtggtggctcacgcctgcaatcccagcactttgggaggccgaggcgggtggatcacgaggtcaggagtttgagaccagcctggccaacatggtgaaaccccgtatctactaaaaatacgaaaaaaaaattagccgggtgtggtggcgggagcctgtaatcccagctattcaggaggccaaggcaggagaatcgcttgaacctgggaaggcagaggttgcagtgagccaagatcgcaccactgcactccagcctgggcaacaagagcgagactccatctcaaaaaaaaaaaaaaaaaaaagtgctttggcaagtatggggcagggaaatcatcttacttccagaggtgcaactgacgcctctggagatctccaaaagttagtaccgtgagtgccattttgagaagaaggtggtaataagtggaaggtacatctccacagagcaagtggcagcagtggcctgtggttttgcagaaatggaaagccaaggccgggtgcggtggctcatgcctgtaatcccagcactttgggaggccgaggtgggtgaatcacctgaggtcaggagtttgaggccagcctggccaacatggtgaaaccccgtctctactgaaaatacaaaaaaaaaaaattagctgggcatggtggcacgcgcctgtaatcccagctacttgggaggctgaggcaggagaattgcttgaacctgggaggcggaggttgcagtgagctgagatcatgccattgcactctagcctgggcgaggagtgaaactccgtctcaaaaaaaaagaaagaaatggaaagccaaggatgctgcagctgtgctttggggttcaaggtaatagcttaccttgttccacactttgtcaaagcactcaccctcctaagctaggaccagtccattcatttgaaactgtgcaatgtgatgtaaatggctctggttcttagactgtggctgtcacagggatggggctccaaggccatcattttcattgcatggctccaagagcagggagttcctcaatgaaaccagctgccttttttggtggggccatttttttggctttggaacccaaagcagccactcatttggtgcttcctcttgttctgccctccatccctcaactcttaatggcatctgtctcctagaacccacgctcttcagctttttggctgatttggagaacagtgacaggtgcctgcctgccttcgtccccttttagattcatttataccacagatgtttctgtgagatactgagatcataaaaagctttaggcttggcagagaggactcaacacccccaggctttcctgaggcaccaactagatgtctcttgagtgagctggactccctgggaaagaagcattgtctgcaacattatattataggaaatgtaccaggaatgtcaataataatgctttgggggggggggttattttgttttgttttgtttttaatgttgtttgtatatttagagctgggccattttccgtgctgcgatttcttctctttgaccctcttcagtgtttggggcaagagtggaccctggtttttatttctttgattgcattgtttactgcactaggaaaaatatagagatacagggaaactacagacaaatttaaggaaaaataggtcaaaaaagaaagcacacaccttaagagtgggaggaatatttttattaaaaacaaaacttggacctgtagtttttttttttcttttttatttttaagaaggcacctttcagaagccatgtttcttccaacagatgttggaaaccccatcgagcaagtaaaagttgcattctccatccctcagatggctgtatgtagtcaaagaaaccctgtaacatggtaaggttgctgttttttttttttttttctttttgagatggagtcttgctctgtagcccaggctggagtgcaatggtgtgatctcagctcactgcaacctccgcctccttggttcaagtgattctcctgcctcagcctcctgagtagctgggattacaggctcccaccaccacgcccgggtaatttttgtatttttagtagagacggggttttgccatgttggccaggctggtcttgaactcctgacctcaagcgatccgcccgccttggcctcccaaagtgttgggattacaggcatgagccaccgcacccagcctgaaggtgactcttaagaatgagatttatgaactccatacagttgtagatttcagtttttaaatagtctggggttttatttttcttttcaaaatatctaatagacttagcaatcaatttagaacaaatatttggcccttaatatatctttagtgagggaagtagcttttatttcctgcttgtttaggttttctgttggtacataaaaacaaaattgctgtctcagactgaatctacttgaatctaggaaggcacatctcatccctattgtggtttttagggacacttttctctttcccagagatgagaggaccaattcaggacagaagagccctcgtgaataccaacgtgctagctcaggttcccttctttcctccatcagagctattggtagggttttaaggtcgtgtgtgcatcatgcttccaatgtcaagagatttcctcaaacagcctgtttactagatgaattttccagctggtgaaatacatgagctttgttgttttcctggtcttccaatagcctgtcattattgttagatattatggcacctgttgttgaatgtaggttcccttacagccctggtctagatgatcctagatggggtgagacatatgcaagccattggtatgtgcataagcagttgcaatgaaccttaggctgacttggtagtaggcatttgtctttctgttcatgcattgaataaacatttttaagaaccatctatgtgccaggctttgtgctaggcactgacagtagagagatgaagacatagtccttgcacttaaggaattcatactccagatgtctggagttaagaaatacatatttcagccaggcatggtggctcacacctagaatcccagcactttcagaagctgaggcagaattgcttgaggccaagagtttaagactagcctggtcaacatagccagaccccatctctataaaaaaatgtaaaaattagtcaagtcttgtggctcgcacttgtagacacaattactcaggatgctgaggcaagaggattttgcttgggcctaggagttcaaggctgtagtgagctatgactttgccactgtactctagcccaggtaacagggcaacatccccagctcagaaaaccaaaactacacatttcattataattgtttttttttgtaattttatgtattttatgcattgaaaaacattatttaagaattggttcataggtttcagcagactgccaaaggcacaaacaagcagctctcctttactgaggtactgaaacagatcctactgcgtaagtgctgtgtgtgatagggctattggctaggagctgagagaacaaagcatgaagtgcctaacccagcttagcggtgtagaggtggggtcagcaaataagggagatcttcctggagaaggcatatacctaagctgatttaggagagaccacttttggctaggtttattgtactacttgattttcaagtaattgggcttatttattctagagaaaaagtcttcagtctcttgcttctgcctgcaaagcaaggcagagtcagcaacatgggcagtctccccactggagaacgctgagtcatgcatgggcttctccaagtttccatcagatgggatccagtgttgaatccagtgcaggactggagtctagctggcaaagggtaaatgcccccaaagccttcctgccatatggtttccacgaaggcctgagagtcagctgtacaactgtcttgtcttggccatgtccctgtttggtccctgccttgttctcttccctttctcaatttccaagctccacccactcctaaaaacaccagtcattctgaagtaaaaaatggacaataaacatgaatattcaagattcaaa

SEQ ID NO: 137212 - DNA, 4559 bp, Homo sapiens
  Payload ID: 6867
  Gene Symbol: GMEB2
  Gene Name: glucocorticoid modulatory element binding protein 2
  Uniprot ID: Q9UKD1
  ENST ID: ENST00000266068
  CDS Start-End: 480-2072
gcgaggacttcttggagtgctttctgcacctgaaactcagttcagggattggggctggctttgagttcaggccaggagagacggaagaactggcaagccgggagcctgcgtccagggaagttgcttggaattccaggcccctcctgtcctcctgctctgagccccacgtggagggagtggctctgtgctttctacccaagggtttcggcttatccagtgggaaaaacgggtggagtgcgcttacaccgccctcggaaccagagcctggagtagcccttctgttgccgctcgtttttgtcaggaggtagcagtctgggactcaagggtgggtctttggagctgattagagatgcctttgtgagtgctatgttgtgtggatgtggagatgactccatccctgtgccctgccttgcttcctccaggacttgggaccctggaggactgacgctgctggcctgggcgtccccttccgctgagccatggcgactcccgacgtgagtgtgcacatggaggaggtggtggttgtgacaactccggacactgcagtggacggcagtggtgtggagggggtgaagaccgtgttggtgacgaccaacttggcccctcacgggggcgacctgacggaagataacatggagacagaaaatgcagcggcagcagctgccgcggccttcacagcctcctcccagctcaaggaagccgtgttagtgaagatggctgaagagggggagaacctggaagctgagattgtgtaccccatcacctgtggagacagcagagccaacctcatctggaggaagtttgtgtgtcccggcatcaatgtgaaatgtgttcagtacgacgagcatgtaatcagcccaaaggaatttgtgcacctggccgggaagtccaccctgaaggactggaagagagccatccgcatgaacggcatcatgctcaggaagatcatggactccggggaactggacttctaccagcatgacaaggtctgctccaacacctgccgcagcacaaagattgacctctcaggagcccgtgtgtccctgagcagccccacgtcggccgagtacattcccctcacgcccgccgcagccgacgtgaatgggtctcctgcgaccatcaccatagagacctgtgaagaccctggcgactggaccgcggccattggagatgacacatttaccttctggcgggggctgaaggacgccggcctgctggacgaggtcatccaggagttccaccaggagctggtggagaccatgagaggcctgcagcagcgggtccaggaccctcccctgcagcttcgagatgctgtacttctcaacaacatcgtgcagaacttcggcatgctggacctggtgaagaaggtgctggccagccacaagtgccagatggaccgctcgcgggagcagtacgcccgggacctggcagccctggagcagcagtgtgatgagcatcgtcgccgagccaaggagctgaagcacaagtcccagcacctcagcaacgtgctcatgacgctgacgccggtctccctgccaccgcctgtgaagcggccccggcttgcacgtgccacatcaggaccggccgccatggcctcgcaggtgctcacccagtctgcccagctggcgcttggcccgggcgtgcccgtcccccagctgaccagcgtgccccttggtaaagtggtgtccaccctgccgtccaccgtcctgggcaagggttcccttcaggcgccccccgccagctccccggcctccccgctgctcgggggatacacagtcttggcctcttccggctccacctaccccagcacagtggagatccacccggacgcgtccagcctcacggtcctgagcacggccgccgtgcaggacggtagcacggtgttcaaggtggtcagcccgctacagctgctcacgttgcctggcctgggccccaccctgcagaacgtggcccaggcctcgcctggctccagcacaattgtgacagtgcccgcaggggctgcccccgggcctgaggagcacacggccaccattgaggtggctgccatggcagaggaccacgagcggaagtagccgacaggagggcgaggcccctgggacggacagggctggctgtctctcagccgcggcagcagggagcgggcagaggccgcagggctggctcgggcaggtgggtcacgtggtctgcagaaccaaagagaggaatcgccaaaacaaatcacgagaagagagaaggggacagaacagcgagagcaacctggaaaatcggtcttcaggtcccacgtttcctcccccttttttcttgggaaatatatttttccatctgttgcttattaatactgtttacacattgggccttgatcaggagccaggtgggcgggggctagggggagcctgggtgcagcagagacagaggaagcagagccaggtgccgagcgcgaccctgcaggtgctggacgcggtgcagcaggtcacgaggcccccatgtctgcacccagccaggtccctggggacgttactaactcatgacttgggagctaagcccaagtgtgaaacctctggatcctatggatttggtttcttcccacagttttctgtaggtttagtgtggctggcgccccgttctcctccagttgggaacatgcacccggagcttggggtgcagatcctgatgggtgcctgcctcccccgcccccagccggtgctcaggtggcccaggggccgcacagacgaggcgtggtccaggcattgttgcacatgtactgagggtgtttttaagtgaattgcttagtaggcttctaggaagagtcagatttatagcattttcaaccaaaataatggtgagtgcctaggcttcccgagttagctctttgggtggcccctgagcccctgtgagtgcacttgaccgggtgcggaggtcctgggcagcctgtccctgagccggcccctcccaggggtctgagatccatgaggtgtgtccctagggcttcagtcctggggcagaggcataaacagaaccagtcactatggaggtcgaggattcccatgtgggcccttcagcttgggctgcttggccacggaacagcccttggctccctggcccccggcccccatgcagcccctgggctggcccttggtggtctctgtccaagggagagcccctgggtgttcaggaggctgccccgggtgggctgctcagggcagctgccgaaggtggagcccagagcctgtctggaagggctgtctgtggctgtcctgagacctggccttggactcacaaggaagaccaggctgaggcccctccaggccagggtcctggggcaggcatctcagggagcagccagcccaggcctcctgccgtctccaacagggcatgtcccgggaggaccctgagtgccagattcccctggacgctcctgctgattctgtcggcagttgaaggcccgtctgaggccccgcaatgcgagggtcctgtgtcccacttcactgctccgaagggaactggctggctgtccgtccagtgagcggcccagaccccacctctgcgccattgtcaccagggccctgtcctggctgccctcacccatgtcaagctactgaggctgtgtcttgtttgttttctctgttacatttttgtttgctgttgtcacagtcagctggtttcggcgtgatgttgatcttttgatgtacatactccgttttaaactcatttccactctagttgagttctgcagcatgcagcggtatgaccctacgggggtcaggagagccctgcggcccccacccaccagctcagaacctgtcactaatacagctgcctgtgaccctgggacccgcaaccttccagctgcttccctttgtcaaagtcacgagtgcgtctgccttgacagccctcgtcaacagaacttccagtgggttgtgggttcatttcctttctttttaagaacagggttgggaccttttctgcccctgccccttagctactgaggcatagggagaggaagttaatttcagagccatacaaaaataagccacaaccagcttcagaattaattcccaatcccccattccaccagggctgggagcccattcccagtgcttcccaaggccctcggggacatctaccgccaacccagctgcttctggcaggggctccaagccccagcgtggggaagggccctggagaagccctcatcctcatgggaaccacactgcagtgggtggggaaggttgttgtcagcaccgcccccggctcctccaggtcctgctggctcctcgggggcagggttccctggacctcccagttctgcgccttggggccagccagtactcagagaggaggaccttctcaaccacgtacagaacacgggttttcatggctgcctttggtttggttttctgagaagataggattggattggattttgcagagggtgagaacttctctgtgcctgctcagaggcgccctagggaagggccatgtttgagttttgctttgtatgttgttttgcaagtatctgcctggtactttgatttaaaataaaaacaattttcatagtt

SEQ ID NO: 137213 - DNA, 4011 bp, Homo sapiens
  Payload ID: 6867
  Gene Symbol: GMEB2
  Gene Name: glucocorticoid modulatory element binding protein 2
  ENST ID: ENST00000370069
  CDS Start-End: 85-1524
tgccctgcaggttgtgccctccgggatcctgattctattctctcctcccttcacttcaccaggggcgacctgacggaagataacatggagacagaaaatgcagcggcagcagctgccgcggccttcacagcctcctcccagctcaaggaagccgtgttagtgaagatggctgaagagggggagaacctggaagctgagattgtgtaccccatcacctgtggagacagcagagccaacctcatctggaggaagtttgtgtgtcccggcatcaatgtgaaatgtgttcagtacgacgagcatgtaatcagcccaaaggaatttgtgcacctggccgggaagtccaccctgaaggactggaagagagccatccgcatgaacggcatcatgctcaggaagatcatggactccggggaactggacttctaccagcatgacaaggtctgctccaacacctgccgcagcacaaagattgacctctcaggagcccgtgtgtccctgagcagccccacgtcggccgagtacattcccctcacgcccgccgcagccgacgtgaatgggtctcctgcgaccatcaccatagagacctgtgaagaccctggcgactggaccgcggccattggagatgacacatttaccttctggcgggggctgaaggacgccggcctgctggacgaggtcatccaggagttccaccaggagctggtggagaccatgagaggcctgcagcagcgggtccaggaccctcccctgcagcttcgagatgctgtacttctcaacaacatcgtgcagaacttcggcatgctggacctggtgaagaaggtgctggccagccacaagtgccagatggaccgctcgcgggagcagtacgcccgggacctggcagccctggagcagcagtgtgatgagcatcgtcgccgagccaaggagctgaagcacaagtcccagcacctcagcaacgtgctcatgacgctgacgccggtctccctgccaccgcctgtgaagcggccccggcttgcacgtgccacatcaggaccggccgccatggcctcgcaggtgctcacccagtctgcccagctggcgcttggcccgggcgtgcccgtcccccagctgaccagcgtgccccttggtaaagtggtgtccaccctgccgtccaccgtcctgggcaagggttcccttcaggcgccccccgccagctccccggcctccccgctgctcgggggatacacagtcttggcctcttccggctccacctaccccagcacagtggagatccacccggacgcgtccagcctcacggtcctgagcacggccgccgtgcaggacggtagcacggtgttcaaggtggtcagcccgctacagctgctcacgttgcctggcctgggccccaccctgcagaacgtggcccaggcctcgcctggctccagcacaattgtgacagtgcccgcaggggctgcccccgggcctgaggagcacacggccaccattgaggtggctgccatggcagaggaccacgagcggaagtagccgacaggagggcgaggcccctgggacggacagggctggctgtctctcagccgcggcagcagggagcgggcagaggccgcagggctggctcgggcaggtgggtcacgtggtctgcagaaccaaagagaggaatcgccaaaacaaatcacgagaagagagaaggggacagaacagcgagagcaacctggaaaatcggtcttcaggtcccacgtttcctcccccttttttcttgggaaatatatttttccatctgttgcttattaatactgtttacacattgggccttgatcaggagccaggtgggcgggggctagggggagcctgggtgcagcagagacagaggaagcagagccaggtgccgagcgcgaccctgcaggtgctggacgcggtgcagcaggtcacgaggcccccatgtctgcacccagccaggtccctggggacgttactaactcatgacttgggagctaagcccaagtgtgaaacctctggatcctatggatttggtttcttcccacagttttctgtaggtttagtgtggctggcgccccgttctcctccagttgggaacatgcacccggagcttggggtgcagatcctgatgggtgcctgcctcccccgcccccagccggtgctcaggtggcccaggggccgcacagacgaggcgtggtccaggcattgttgcacatgtactgagggtgtttttaagtgaattgcttagtaggcttctaggaagagtcagatttatagcattttcaaccaaaataatggtgagtgcctaggcttcccgagttagctctttgggtggcccctgagcccctgtgagtgcacttgaccgggtgcggaggtcctgggcagcctgtccctgagccggcccctcccaggggtctgagatccatgaggtgtgtccctagggcttcagtcctggggcagaggcataaacagaaccagtcactatggaggtcgaggattcccatgtgggcccttcagcttgggctgcttggccacggaacagcccttggctccctggcccccggcccccatgcagcccctgggctggcccttggtggtctctgtccaagggagagcccctgggtgttcaggaggctgccccgggtgggctgctcagggcagctgccgaaggtggagcccagagcctgtctggaagggctgtctgtggctgtcctgagacctggccttggactcacaaggaagaccaggctgaggcccctccaggccagggtcctggggcaggcatctcagggagcagccagcccaggcctcctgccgtctccaacagggcatgtcccgggaggaccctgagtgccagattcccctggacgctcctgctgattctgtcggcagttgaaggcccgtctgaggccccgcaatgcgagggtcctgtgtcccacttcactgctccgaagggaactggctggctgtccgtccagtgagcggcccagaccccacctctgcgccattgtcaccagggccctgtcctggctgccctcacccatgtcaagctactgaggctgtgtcttgtttgttttctctgttacatttttgtttgctgttgtcacagtcagctggtttcggcgtgatgttgatcttttgatgtacatactccgttttaaactcatttccactctagttgagttctgcagcatgcagcggtatgaccctacgggggtcaggagagccctgcggcccccacccaccagctcagaacctgtcactaatacagctgcctgtgaccctgggacccgcaaccttccagctgcttccctttgtcaaagtcacgagtgcgtctgccttgacagccctcgtcaacagaacttccagtgggttgtgggttcatttcctttctttttaagaacagggttgggaccttttctgcccctgccccttagctactgaggcatagggagaggaagttaatttcagagccatacaaaaataagccacaaccagcttcagaattaattcccaatcccccattccaccagggctgggagcccattcccagtgcttcccaaggccctcggggacatctaccgccaacccagctgcttctggcaggggctccaagccccagcgtggggaagggccctggagaagccctcatcctcatgggaaccacactgcagtgggtggggaaggttgttgtcagcaccgcccccggctcctccaggtcctgctggctcctcgggggcagggttccctggacctcccagttctgcgccttggggccagccagtactcagagaggaggaccttctcaaccacgtacagaacacgggttttcatggctgcctttggtttggttttctgagaagataggattggattggattttgcagagggtgagaacttctctgtgcctgctcagaggcgccctagggaagggccatgtttgagttttgctttgtatgttgttttgcaagtatctgcctggtactttgatttaaaataaaaacaattttcatagtt

SEQ ID NO: 137214 - DNA, 4223 bp, Homo sapiens
  Payload ID: 6867
  Gene Symbol: GMEB2
  Gene Name: glucocorticoid modulatory element binding protein 2
  Uniprot ID: Q9UKD1
  ENST ID: ENST00000370077
  CDS Start-End: 144-1736
gcggccgccgccgccgcccgccgccgccgcagctcccgacgccgccgcccccgccgggtgcctaagcaggcccggcgcggccccaggacttgggaccctggaggactgacgctgctggcctgggcgtccccttccgctgagccatggcgactcccgacgtgagtgtgcacatggaggaggtggtggttgtgacaactccggacactgcagtggacggcagtggtgtggagggggtgaagaccgtgttggtgacgaccaacttggcccctcacgggggcgacctgacggaagataacatggagacagaaaatgcagcggcagcagctgccgcggccttcacagcctcctcccagctcaaggaagccgtgttagtgaagatggctgaagagggggagaacctggaagctgagattgtgtaccccatcacctgtggagacagcagagccaacctcatctggaggaagtttgtgtgtcccggcatcaatgtgaaatgtgttcagtacgacgagcatgtaatcagcccaaaggaatttgtgcacctggccgggaagtccaccctgaaggactggaagagagccatccgcatgaacggcatcatgctcaggaagatcatggactccggggaactggacttctaccagcatgacaaggtctgctccaacacctgccgcagcacaaagattgacctctcaggagcccgtgtgtccctgagcagccccacgtcggccgagtacattcccctcacgcccgccgcagccgacgtgaatgggtctcctgcgaccatcaccatagagacctgtgaagaccctggcgactggaccgcggccattggagatgacacatttaccttctggcgggggctgaaggacgccggcctgctggacgaggtcatccaggagttccaccaggagctggtggagaccatgagaggcctgcagcagcgggtccaggaccctcccctgcagcttcgagatgctgtacttctcaacaacatcgtgcagaacttcggcatgctggacctggtgaagaaggtgctggccagccacaagtgccagatggaccgctcgcgggagcagtacgcccgggacctggcagccctggagcagcagtgtgatgagcatcgtcgccgagccaaggagctgaagcacaagtcccagcacctcagcaacgtgctcatgacgctgacgccggtctccctgccaccgcctgtgaagcggccccggcttgcacgtgccacatcaggaccggccgccatggcctcgcaggtgctcacccagtctgcccagctggcgcttggcccgggcgtgcccgtcccccagctgaccagcgtgccccttggtaaagtggtgtccaccctgccgtccaccgtcctgggcaagggttcccttcaggcgccccccgccagctccccggcctccccgctgctcgggggatacacagtcttggcctcttccggctccacctaccccagcacagtggagatccacccggacgcgtccagcctcacggtcctgagcacggccgccgtgcaggacggtagcacggtgttcaaggtggtcagcccgctacagctgctcacgttgcctggcctgggccccaccctgcagaacgtggcccaggcctcgcctggctccagcacaattgtgacagtgcccgcaggggctgcccccgggcctgaggagcacacggccaccattgaggtggctgccatggcagaggaccacgagcggaagtagccgacaggagggcgaggcccctgggacggacagggctggctgtctctcagccgcggcagcagggagcgggcagaggccgcagggctggctcgggcaggtgggtcacgtggtctgcagaaccaaagagaggaatcgccaaaacaaatcacgagaagagagaaggggacagaacagcgagagcaacctggaaaatcggtcttcaggtcccacgtttcctcccccttttttcttgggaaatatatttttccatctgttgcttattaatactgtttacacattgggccttgatcaggagccaggtgggcgggggctagggggagcctgggtgcagcagagacagaggaagcagagccaggtgccgagcgcgaccctgcaggtgctggacgcggtgcagcaggtcacgaggcccccatgtctgcacccagccaggtccctggggacgttactaactcatgacttgggagctaagcccaagtgtgaaacctctggatcctatggatttggtttcttcccacagttttctgtaggtttagtgtggctggcgccccgttctcctccagttgggaacatgcacccggagcttggggtgcagatcctgatgggtgcctgcctcccccgcccccagccggtgctcaggtggcccaggggccgcacagacgaggcgtggtccaggcattgttgcacatgtactgagggtgtttttaagtgaattgcttagtaggcttctaggaagagtcagatttatagcattttcaaccaaaataatggtgagtgcctaggcttcccgagttagctctttgggtggcccctgagcccctgtgagtgcacttgaccgggtgcggaggtcctgggcagcctgtccctgagccggcccctcccaggggtctgagatccatgaggtgtgtccctagggcttcagtcctggggcagaggcataaacagaaccagtcactatggaggtcgaggattcccatgtgggcccttcagcttgggctgcttggccacggaacagcccttggctccctggcccccggcccccatgcagcccctgggctggcccttggtggtctctgtccaagggagagcccctgggtgttcaggaggctgccccgggtgggctgctcagggcagctgccgaaggtggagcccagagcctgtctggaagggctgtctgtggctgtcctgagacctggccttggactcacaaggaagaccaggctgaggcccctccaggccagggtcctggggcaggcatctcagggagcagccagcccaggcctcctgccgtctccaacagggcatgtcccgggaggaccctgagtgccagattcccctggacgctcctgctgattctgtcggcagttgaaggcccgtctgaggccccgcaatgcgagggtcctgtgtcccacttcactgctccgaagggaactggctggctgtccgtccagtgagcggcccagaccccacctctgcgccattgtcaccagggccctgtcctggctgccctcacccatgtcaagctactgaggctgtgtcttgtttgttttctctgttacatttttgtttgctgttgtcacagtcagctggtttcggcgtgatgttgatcttttgatgtacatactccgttttaaactcatttccactctagttgagttctgcagcatgcagcggtatgaccctacgggggtcaggagagccctgcggcccccacccaccagctcagaacctgtcactaatacagctgcctgtgaccctgggacccgcaaccttccagctgcttccctttgtcaaagtcacgagtgcgtctgccttgacagccctcgtcaacagaacttccagtgggttgtgggttcatttcctttctttttaagaacagggttgggaccttttctgcccctgccccttagctactgaggcatagggagaggaagttaatttcagagccatacaaaaataagccacaaccagcttcagaattaattcccaatcccccattccaccagggctgggagcccattcccagtgcttcccaaggccctcggggacatctaccgccaacccagctgcttctggcaggggctccaagccccagcgtggggaagggccctggagaagccctcatcctcatgggaaccacactgcagtgggtggggaaggttgttgtcagcaccgcccccggctcctccaggtcctgctggctcctcgggggcagggttccctggacctcccagttctgcgccttggggccagccagtactcagagaggaggaccttctcaaccacgtacagaacacgggttttcatggctgcctttggtttggttttctgagaagataggattggattggattttgcagagggtgagaacttctctgtgcctgctcagaggcgccctagggaagggccatgtttgagttttgctttgtatgttgttttgcaagtatctgcctggtactttgatttaaaataaaaacaattttcatagtt

SEQ ID NO: 137215 - DNA, 2421 bp, Homo sapiens
  Payload ID: 6868
  Gene Symbol: GCK
  Gene Name: glucokinase (hexokinase 4)
  Uniprot ID: P35557
  ENST ID: ENST00000345378
  CDS Start-End: 163-1563
agtgcagaagccctgggctgccagcctcaggcagctctccatccaagcagccgttgctgccacaggcgggccttacgctccaaggctacagcatgtgctaggcctcagcaggcaggagcatctctgcctcccaaagcatctacctcttagcccctcggagagatggcgatggatgtcacaaggagccaggcccagacagccttgactctggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgctcttcgactacatctctgagtgcatctccgacttcctggacaagcatcagatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagtttt

SEQ ID NO: 137216 - DNA, 1311 bp, Homo sapiens
  Payload ID: 6868
  Gene Symbol: GCK
  Gene Name: glucokinase (hexokinase 4)
  ENST ID: ENST00000336642
  CDS Start-End: 1-450
ggcggggtccggacggggatgccaagagcagggatgggagcgagcctgcgtccgggcactggtccccatcccgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagttttaaa

SEQ ID NO: 137217 - DNA, 2539 bp, Homo sapiens
  Payload ID: 6868
  Gene Symbol: GCK
  Gene Name: glucokinase (hexokinase 4)
  Uniprot ID: P35557
  ENST ID: ENST00000395796
  CDS Start-End: 286-1680
aagccctgggctgccagcctcaggcagctctccatccaagcagccgttgctgccacaggcgggccttacgctccaaggctacagcatgtgctaggcctcagcaggcaggagcatctctgcctcccaaagcatctacctcttagcccctcggagagatggcgatggatgtcacaaggagccaggcccagacagccttgactctgccagactctcctctgaactcgggcctcacatggccaactgctacttggaacaaatcgccccttggctggcagatgtgttaacatgcccagaccaagatcccaactcccacaacccaactcccaggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgctcttcgactacatctctgagtgcatctccgacttcctggacaagcatcagatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagtttta

SEQ ID NO: 137218 - DNA, 2729 bp, Homo sapiens
  Payload ID: 6868
  Gene Symbol: GCK
  Gene Name: glucokinase (hexokinase 4)
  Uniprot ID: P35557
  ENST ID: ENST00000403799
  CDS Start-End: 471-1868
gagcaggaaatgccgagcggcgcctgagccccagggaagcaggctaggatgtgagagacacagtcacctgcagcctaattactcaaaagctgtccccaggtcacagaagggagaggacatttcccactgaatctgtctgaaggacactaagccccacagctcaacacaaccaggagagaaagcgctgaggacgccacccaagcgcccagcaatggccctgcctggagaacatccaggctcagtgaggaagggtccagaagggaatgcttgccgactcgttggagaacaatgaaaaggaggaaactgtgactgaacctcaaaccccaaaccagcccgaggagaaccacattctcccagggacccagggcgggccgtgacccctgcggcggagaagccttggatatttccacttcagaagcctactggggaaggctgaggggtcccagctccccacgctggctgctgtgcagatgctggacgacagagccaggatggaggccgccaagaaggagaaggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgctcttcgactacatctctgagtgcatctccgacttcctggacaagcatcagatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagttttaaa

SEQ ID NO: 137219 - DNA, 1385 bp, Homo sapiens
  Payload ID: 6868
  Gene Symbol: GCK
  Gene Name: glucokinase (hexokinase 4)
  ENST ID: ENST00000437084
  CDS Start-End: 35-1381
ggggtcccagctccccacgctggctgctgtgcagatgctggacgacagagccaggatggaggccgccaagaaggagaaggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagc

SEQ ID NO: 137220 - DNA, 2260 bp, Homo sapiens
  Payload ID: 6868
  Gene Symbol: GCK
  Gene Name: glucokinase (hexokinase 4)
  Uniprot ID: P35557
  ENST ID: ENST00000616242
  CDS Start-End: 1-1395
atgcccagaccaagatcccaactcccacaacccaactcccaggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgctcttcgactacatctctgagtgcatctccgacttcctggacaagcatcagatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagttttaaacatg

SEQ ID NO: 137221 - DNA, 2186 bp, Homo sapiens
  Payload ID: 6869
  Gene Symbol: GCKR
  Gene Name: glucokinase (hexokinase 4) regulator
  ENST ID: ENST00000264717
  CDS Start-End: 64-1941
gtgaccagaggggtttgtgtggctgaagaggcaggaggaacagtgtatccacagcgtgggaccatgccaggcacaaaacggtttcaacatgtcattgagaccccggagcctggcaagtgggagttgtctgggtacgaggcagctgtgccaatcacggagaagtcaaacccactgacccaggatctagacaaagcagatgctgagaacattgttcgactgctagggcaatgtgatgctgagatcttccaggaggaggggcaagccctgtccacataccagagactctacagcgaatccattctgaccaccatggtacaggtggctgggaaagttcaggaagtgctgaaggagccagatggggggctggttgtgctgagtggagggggcacctctggccggatggcattcctcatgtcggtgtcctttaatcagctgatgaaaggtctgggacagaaacctctttacacctacctcattgcaggtggtgacaggtctgtggtggcctctagggaggggacagaagatagtgccttgcacgggattgaggaactgaagaaggtggctgccgggaagaagagagtgattgtcattggcatttctgtgggactctctgctccctttgtggcaggccagatggactgctgcatgaacaacacagctgtcttcttgccagtcctggttggcttcaatccagtgagcatggccagaaatgaccccattgaagactggagttcaacattccgacaagtagcagagcggatgcagaaaatgcaggagaaacagaaagcttttgtgctcaatcctgccatcgggcccgagggtctcagcggctcctcccggatgaaaggtggaagtgccaccaagattctgctggaaaccctgttattagcagcccataagactgtggaccagggcattgcagcatctcaaagatgcctcctggaaatcttgcggacatttgagcgagctcatcaggtgacctacagccaaagccccaagattgccaccctgatgaagagtgtcagcaccagtctggagaagaaaggccacgtgtacctggttggctggcagaccctgggcatcattgccatcatggatggagtagagtgcatccacacctttggtgctgatttccgagatgtccgtggctttctcattggtgatcacagtgacatgtttaaccagaaggctgagctcaccaaccagggtccccagttcaccttctcccaggaggacttcctgacttccatccttccctctctcacggaaatcgatactgtggtcttcattttcaccctggatgacaacctcacggaggtgcagactatagtggagcaggtgaaagagaagaccaaccacatccaggccctggcacacagcaccgtgggtcagaccttgctgatccctctgaagaagctctttccctccatcatcagcatcacatggccactgcttttctttgaatatgaagggaacttcatccagaagttccagcgtgagctaagcaccaaatgggtgctgaatacagtgagtacaggtgctcatgtgcttcttggtaagatcctacaaaaccacatgttggaccttcggattagcaactccaagctcttctggcgggcgctggccatgctgcagcggttctctggacagtccaaggctcgatgcatcgagagcctcctccgagcgatccactttccccagccactgtcagatgatattcgggctgctcccatctcctgccatgtccaggttgcacatgagaaggaacaggtgatacccatcgccttgctgagcctcctattccggtgctcgatcactgaggctcaggcacacctggctgcagctccttctgtctgtgaggctgtcaggagtgctcttgctgggccaggtcagaagcgcactgcggaccccctcgagatcctagagcctgacgttcagtgaacccatgtttctgggtgggtgaaaggggcccaaccctgcccacttcagcccagcccgcccaaggggacttgtgccagcagaacatgtgggaggaagaagccccgtttccagggcatccgcagcccagggtagggagaaatattctctccactttgggggagagttcttgctctcgacctagtggtttctactctcaccgacttattctgatttcagaaataaaatgaaatgtcttattttggaaa

SEQ ID NO: 137222 - DNA, 568 bp, Homo sapiens
  Payload ID: 6869
  Gene Symbol: GCKR
  Gene Name: glucokinase (hexokinase 4) regulator
  Uniprot ID: Q14397
  ENST ID: ENST00000417872
  CDS Start-End: 58-510
agaggggtttgtgtggctgaagaggcaggaggaacagtgtatccacagcgtgggaccatgccaggcacaaaacggtttcaacatgtcattgagaccccggagcctggcaagtgggagttgtctgggtacgaggcagctgtgccaatcacggagaagtcaaacccactgacccaggatctagacaaagcagatgctgagaacattgttcgactgctagggcaatgtgatgctgagatcttccaggaggaggggcaagccctgtccacataccagagactctacagcgaatccattctgaccaccatggtacaggtggctgggaaagttcaggaagtgctgaaggagccagatggggggctggttgtgctgagtggagggggcacctctggccggatggcattcctcatgtcggtgtcctttaatcagctgatgaaaggtctgggacagaaacctctttacacctacctcattgcaggtggtgacaggtggctgccgggaagaagagagtgattgtcattggcatttctgtgggactctctgctccctttgtggcaggccagatggactg

SEQ ID NO: 137223 - DNA, 701 bp, Homo sapiens
  Payload ID: 6869
  Gene Symbol: GCKR
  Gene Name: glucokinase (hexokinase 4) regulator
  ENST ID: ENST00000453813
  CDS Start-End: 1-684
ccaatcacggagaagtcaaacccactgacccaggatctagacaaagcagatgctgagaacattgttcgactgctagggcaatgtgatgctgagatcttccaggaggaggggcaagccctgtccacataccagagactctacagcgaatccattctgaccaccatggtacaggtggctgggaaagttcaggaagtgctgaaggagccagatggggggctggttgtgctgagtggagggggcacctctggccggatggcattcctcatgtcggtgtcctttaatcagctgatgaaaggtctgggacagaaacctctttacacctacctcattgcaggtggtgacaggtctgtggtggcctctagggaggggacagaagatagtgccttgcacgggattgaggaactgaagaaggtggctgccgggaagaagagagtgattgtcattggcatttctgtgggactctctgctccctttgtggcaggccagatggactgctgcatgaacaacacagctgtcttcttgccagtcctggttggcttcaatccagtgagcatggccaggcacccctttcctcccccgaggatcctcagatctctcactgtcttcccttccctgagagcccctcattaccaaatcacctccctcttattctctatgtcagtggtcactcttatttcagaataaatcaacatattaaacca

SEQ ID NO: 137224 - DNA, 789 bp, Homo sapiens
  Payload ID: 6869
  Gene Symbol: GCKR
  Gene Name: glucokinase (hexokinase 4) regulator
  ENST ID: ENST00000411584
  CDS Start-End: 1-569
agcgagctcatcaggtgacctacagccaaagccccaagattgccaccctgatgaagagtgtcagcaccagtctggagaagaaaggccacgtgtacctggttggctggcagaccctgggcatcattgccatcatggatggagtagagtgcatccacacctttggtgctgatttccgagatgtccgtggctttctcattggtgatcacagtgacatgtttaaccagaaggctgagctcaccaaccagggtccccagttcaccttctcccaggaggacttcctgacttccatccttccctctctcacggaaatcgatactgtggtcttcattttcaccctggatgacaacctcacggaggtgcagactatagtggagcaggtgaaagagaagaccaaccacatccaggccctggcacacagcaccgtgggtcagaccttgctgatccctctgaagaagctctttccctccatcatcagcatcacatggccactgcttttctttgaatatgaagggaacttcatccagagatcgggtttctccacattgcccaggctgtttgccaactcctagactcaagtgatccacccgccttagcctcccaaagtgctgagattgcaggcgtgagccactacgcctagccaaaacactgtatttttaaagaaaaatgttcattttaacagccatacattttttatagatacattttttatagtaaagacgttacaaattacagaaatgcaaaaaagaaaaaatcactccaaatctaccatcttcaaaaaaaaaaaaaaaa

SEQ ID NO: 137225 - DNA, 5122 bp, Homo sapiens
  Payload ID: 6870
  Gene Symbol: GNS
  Gene Name: glucosamine (N-acetyl)-6-sulfatase
  Uniprot ID: P15586
  ENST ID: ENST00000258145
  CDS Start-End: 172-1830
cccctgtccctggctcacgtgatcgcgcctagggagaaaacgtctgactccagccaccggccttcaaggcacggctttttattccttcggctggtcggcctctcgcccttcagctacctgtgcgtccctccgtcccgtcccgtcccggggtcaccccggagcctgtccgctatgcggctcctgcctctagccccaggtcggctccggcggggcagcccccgccacctgccctcctgcagcccagcgctgctactgctggtgctgggcggctgcctgggggtcttcggggtggctgcgggaacccggaggcccaacgtggtgctgctcctcacggacgaccaggacgaagtgctcggcggcatgacaccgctaaagaaaaccaaagctctcatcggagagatggggatgactttttccagtgcttatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgagtacggagccccagatgcaggtggactagaacacgttcctctgggttggagttactggtatgccttggaaaagaattctaagtattataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatacctcagacaatggctatcacacaggacagttttccttgccaatagacaagagacagctgtatgagtttgatatcaaagttccactgttggttcgaggacctgggatcaaaccaaatcagacaagcaagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattctttttatcctggggccacagttcttgattattcctcttgtggttaaagactgaatttgtaaacccattcagataaatggcagtactttaggacacacacaaacacacagacacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtagctcttgaaggtgatagccatctactttccagtggctgccaaccacagggagtgccagttaacactggaaggattaaggcaaggtcccttctcttgagactcccctctgagatctgaaaaatgaagtggcttaggaacatcagcagtgaagaactgccaagagttggtgaaggttgtctcttccgagggccttctgaagacagggctcttgaacagacaagtggaagggctgtaccagggataaaggaaagaagtgcctgtccagcagggagcttgaatttaagttccatgtatgaagtcattggctctatctgcatttttctgtcattctcttcatttgttttaaggtggaaaattttcttacagttgatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacgcaccaccacgcccagctaattttttgtatttttagtagagacagagtttcaccatgttggccaggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgattttagctttatttaaagtcttctgtccagctttaagcactttgtaagacatggctgaaagtagcttttctatcagaattgcagatagtcatgttgggctaacagtcaattggatatattcctttacctcacatgaccccagcaactgtggtggtatctagaggtgaaacaggcaagtgaaatggacacctctgctgtgaatgttttagagaaggaaattcaaaaaatgttgtaactgaaagcactgttgaatatgggtatcggctttctttttcactttgactcttaacattatcagtcaacttccacattaatgaaagttgaccatagttatttccaaataaaaagaaaccaactcttaccaggtcttggactgtgatgtcatattattcagttttatgcttgttcctgagcagaactcataagagtgacatagtcagctgctgacggcacctcagccacgccactcttactcagttcagtgggtgtgcttgcgtggtaggatgtggtgcagccctctctacgctcttctatttttggtatatttcctatctaaccttcaaatagcttccaattctttttttcttggactggcttcattctgaatttgtgctaaaataatctttcataaagagacctcagtttatagcgtaacagactacacaatgcactgatgttttcataatgtttaagggacccactgcaagaagcttgctgcctccttttaattgtattcatttagattttgattttccatgttaagaaggtgaggtccatgttggtgcccttcagagtagagaaccatgtaaacattaggaatgaacagaggccttaggaatgaatagagagtttgccttatacaatttcctgttacaaagctctccctctcatgcaaagtagggaacaccttttgagcatctttgaatttgacaaatggtgctgttgcaaacactttttttttgagatgaagtctcgcggttgtcacccgggctggagtgcagtggcgtgatctcggctcactgcaacttccacctcctgggttccagcagttctcctgcctcagcctcccaagtagctgagattacaggcgcctgccaccccacctggctgatttttgtaattttagtagagacggggtttcaccatgttggccaggctgattaactcctgacctcaggtgatccacctttctcggcctcccaaagtgctgggattacgggtgtgagccaccgtgcccggcctgcaaacacattttaattgacaacactagggctgttgtacaaaatagtaatgatagccatggaagttttaccttattctgtgagaagtgttcttaaacttattaagtgtctaaactaaggtttagtgcttttttaaaggaaagttgtcccaggattcatcctaaagaaagcaaaagttaattcaactgatccaccaatggaattagatgggtagagttgggttcttgagttttaccaccacttagttcccactgaattttgtaacttcctgtgtttgcatcctctgttcctattctgcccttgctctgtgtcatctcagtcatttgacttagaaagtgcccttcaaaaggaccctgttcactgctgcacttttcaatgaattaaaatttatttctgttcta

SEQ ID NO: 137226 - DNA, 4877 bp, Homo sapiens
  Payload ID: 6870
  Gene Symbol: GNS
  Gene Name: glucosamine (N-acetyl)-6-sulfatase
  ENST ID: ENST00000418919
  CDS Start-End: 91-1581
gctgaccatttgggaataaaagattgagtaagatgtaacaaaacaggaattctgggctgtgtgtctcaatttattggaagaaattgtttaatggataattacttacttttacagacaccgctaaagaaaaccaaagctctcatcggagagatggggatgactttttccagtgcttatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgagtacggagccccagatgcaggtggactagaacacgttcctctgggttggagttactggtatgccttggaaaagaattctaagtattataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatacctcagacaatggctatcacacaggacagttttccttgccaatagacaagagacagctgtatgagtttgatatcaaagttccactgttggttcgaggacctgggatcaaaccaaatcagacaagcaagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattctttttatcctggggccacagttcttgattattcctcttgtggttaaagactgaatttgtaaacccattcagataaatggcagtactttaggacacacacaaacacacagacacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtagctcttgaaggtgatagccatctactttccagtggctgccaaccacagggagtgccagttaacactggaaggattaaggcaaggtcccttctcttgagactcccctctgagatctgaaaaatgaagtggcttaggaacatcagcagtgaagaactgccaagagttggtgaaggttgtctcttccgagggccttctgaagacagggctcttgaacagacaagtggaagggctgtaccagggataaaggaaagaagtgcctgtccagcagggagcttgaatttaagttccatgtatgaagtcattggctctatctgcatttttctgtcattctcttcatttgttttaaggtggaaaattttcttacagttgatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacgcaccaccacgcccagctaattttttgtatttttagtagagacagagtttcaccatgttggccaggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgattttagctttatttaaagtcttctgtccagctttaagcactttgtaagacatggctgaaagtagcttttctatcagaattgcagatagtcatgttgggctaacagtcaattggatatattcctttacctcacatgaccccagcaactgtggtggtatctagaggtgaaacaggcaagtgaaatggacacctctgctgtgaatgttttagagaaggaaattcaaaaaatgttgtaactgaaagcactgttgaatatgggtatcggctttctttttcactttgactcttaacattatcagtcaacttccacattaatgaaagttgaccatagttatttccaaataaaaagaaaccaactcttaccaggtcttggactgtgatgtcatattattcagttttatgcttgttcctgagcagaactcataagagtgacatagtcagctgctgacggcacctcagccacgccactcttactcagttcagtgggtgtgcttgcgtggtaggatgtggtgcagccctctctacgctcttctatttttggtatatttcctatctaaccttcaaatagcttccaattctttttttcttggactggcttcattctgaatttgtgctaaaataatctttcataaagagacctcagtttatagcgtaacagactacacaatgcactgatgttttcataatgtttaagggacccactgcaagaagcttgctgcctccttttaattgtattcatttagattttgattttccatgttaagaaggtgaggtccatgttggtgcccttcagagtagagaaccatgtaaacattaggaatgaacagaggccttaggaatgaatagagagtttgccttatacaatttcctgttacaaagctctccctctcatgcaaagtagggaacaccttttgagcatctttgaatttgacaaatggtgctgttgcaaacactttttttttgagatgaagtctcgcggttgtcacccgggctggagtgcagtggcgtgatctcggctcactgcaacttccacctcctgggttccagcagttctcctgcctcagcctcccaagtagctgagattacaggcgcctgccaccccacctggctgatttttgtaattttagtagagacggggtttcaccatgttggccaggctgattaactcctgacctcaggtgatccacctttctcggcctcccaaagtgctgggattacgggtgtgagccaccgtgcccggcctgcaaacacattttaattgacaacactagggctgttgtacaaaatagtaatgatagccatggaagttttaccttattctgtgagaagtgttcttaaacttattaagtgtctaaactaaggtttagtgcttttttaaaggaaagttgtcccaggattcatcctaaagaaagcaaaagttaattcaactgatccaccaatggaattagatgggtagagttgggttcttgagttttaccaccacttagttcccactgaattttgtaacttcctgtgtttgcatcctctgttcctattctgcccttgctctgtgtcatctcagtcatttgacttagaaagtgcccttcaaaaggaccctgttcactgctgcacttttcaatgaattaaaatttatttctgttctagtgg

SEQ ID NO: 137227 - DNA, 907 bp, Homo sapiens
  Payload ID: 6870
  Gene Symbol: GNS
  Gene Name: glucosamine (N-acetyl)-6-sulfatase
  ENST ID: ENST00000540196
  CDS Start-End: 1-907
ttataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatacctcagacaatggctatcacacaggacagttttccttgccaatagacaagagacagctgtatgagtttgatatcaaagttccactgttggttcgaggacctgggatcaaaccaaatcagacaagcaagagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacc

SEQ ID NO: 137228 - DNA, 2164 bp, Homo sapiens
  Payload ID: 6870
  Gene Symbol: GNS
  Gene Name: glucosamine (N-acetyl)-6-sulfatase
  ENST ID: ENST00000543646
  CDS Start-End: 131-1885
gtctgactccagccaccggccttcaaggcacggctttttattccttcggctggtcggcctctcgcccttcagctacctgtgcgtccctccgtcccgtcccgtcccggggtcaccccggagcctgtccgctatgcggctcctgcctctagccccaggtcggctccggcggggcagcccccgccacctgccctcctgcagcccagcgctgctactgctggtgctgggcggctgcctgggggtcttcggggtggctgcgggaacccggaggcccaacgtggtgctgctcctcacggacgaccaggacgaagtgctcggcggcatggctttttcagaatattctaccactaattgtcaaacaggactccaaggggaagagctaggacaagagcatttgagaacttacttggagccgagcagaacaccgctaaagaaaaccaaagctctcatcggagagatggggatgactttttccagtgcttatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgagtacggagccccagatgcaggtggactagaacacgttcctctgggttggagttactggtatgccttggaaaagaattctaagtattataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatacctcagacaatggctatcacacaggacagttttccttgccaatagacaagagacagctgtatgagtttgatatcaaagttccactgttggttcgaggacctgggatcaaaccaaatcagacaagcaagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattctttttatcct

SEQ ID NO: 137229 - DNA, 2020 bp, Homo sapiens
  Payload ID: 6870
  Gene Symbol: GNS
  Gene Name: glucosamine (N-acetyl)-6-sulfatase
  Uniprot ID: P15586
  ENST ID: ENST00000542058
  CDS Start-End: 156-1754
acgtgatcgcgcctagggagaaaacgtctgactccagccaccggccttcaaggcacggctttttattccttcggctggtcggcctctcgcccttcagctacctgtgcgtccctccgtcccgtcccgtcccggggtcaccccggagcctgtccgctatgcggctcctgcctctagccccaggtcggctccggcggggcagcccccgccacctgccctcctgcagcccagcgctgctactgctggtgctgggcggctgcctgggggtcttcggggtggctgcgggaacccggaggcccaacgtggtgctgctcctcacggacgaccaggacgaagtgctcggcggcatgtatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgagtacggagccccagatgcaggtggactagaacacgttcctctgggttggagttactggtatgccttggaaaagaattctaagtattataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatacctcagacaatggctatcacacaggacagttttccttgccaatagacaagagacagctgtatgagtttgatatcaaagttccactgttggttcgaggacctgggatcaaaccaaatcagacaagcaagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgta

SEQ ID NO: 137230 - DNA, 906 bp, Homo sapiens
  Payload ID: 6870
  Gene Symbol: GNS
  Gene Name: glucosamine (N-acetyl)-6-sulfatase
  ENST ID: ENST00000545273
  CDS Start-End: 164-906
gcaagcattttgacttcctgcacttttatacaggatggagctggccggaaccaaacttgtctctagaatcatacaagactctctttggctgttgcttagagctgaccatttgggaataaaagattgaacaccgctaaagaaaaccaaagctctcatcggagagatggggatgactttttccagtgcttatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgagtacggagccccagatgcaggtggactagaacacgttcctctgggttggagttactggtatgccttggaaaagaattctaagtattataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatac

SEQ ID NO: 137231 - DNA, 2565 bp, Homo sapiens
  Payload ID: 6871
  Gene Symbol: GNE
  Gene Name: glucosamine (UDP-N-acetyl)-2-epimerase/N-acetylmannosamine kinase
  Uniprot ID: Q9Y223
  ENST ID: ENST00000377902
  CDS Start-End: 222-2390
gtgggcgtggctgggcgagcgaggagtggggacaaggtcgagcgacgagtcgtctacccgcgcgcccgagcgcggaaaccgaggggcaggctcgcgctctgcctgcttcgtggcgcttggttcgtccctcgcccgaggagcgcggtggcggcgtgggagggagcctctgacggcgtctggaactctattttaagaacctctcaaaacgaaacaagcaaatcatggagaagaatggaaataaccgaaagctgcgggtttgtgttgctacttgtaaccgtgcagattattctaaacttgccccgatcatgtttggcattaaaaccgaacctgagttctttgaacttgatgttgtggtacttggctctcacctgatagatgactatggaaatacatatcgaatgattgaacaagatgactttgacattaacaccaggctacacacaattgtgaggggagaagatgaggcagccatggtggagtcagtaggcctggccctagtgaagctgccagatgtccttaatcgcctgaagcctgatatcatgattgttcatggagacaggtttgatgccctggctctggccacatctgctgccttgatgaacatccgaatccttcacattgaaggtggggaagtcagtgggaccattgatgactctatcagacatgccataacaaaactggctcattatcatgtgtgctgcacccgcagtgcagagcagcacctgatatccatgtgtgaggaccatgatcgcatccttttggcaggctgcccttcctatgacaaacttctctcagccaagaacaaagactacatgagcatcattcgcatgtggctaggtgatgatgtaaaatctaaagattacattgttgcactacagcaccctgtgaccactgacattaagcattccataaaaatgtttgaattaacattggatgcacttatctcatttaacaagcggaccctagtcctgtttccaaatattgacgcagggagcaaagagatggttcgagtgatgcggaagaagggcattgagcatcatcccaactttcgtgcagttaaacacgtcccatttgaccagtttatacagttggttgcccatgctggctgtatgattgggaacagcagctgtggggttcgagaagttggagcttttggaacacctgtgatcaacctgggaacacgtcagattggaagagaaacaggggagaatgttcttcatgtccgggatgctgacacccaagacaaaatattgcaagcactgcaccttcagtttggtaaacagtacccttgttcaaagatatatggggatggaaatgctgttccaaggattttgaagtttctcaaatctatcgatcttcaagagccactgcaaaagaaattctgctttcctcctgtgaaggagaatatctctcaagatattgaccatattcttgaaactctaagtgccttggccgttgatcttggcgggacgaacctccgagttgcaatagtcagcatgaagggtgaaatagttaagaagtatactcagttcaatcctaaaacctatgaagagaggattaatttaatcctacagatgtgtgtggaagctgcagcagaagctgtaaaactgaactgcagaattttgggagtaggcatttccacaggtggccgtgtaaatcctcgggaaggaattgtgctgcattcaaccaaactgatccaagagtggaactctgtggaccttaggacccccctttctgacactttgcatctccctgtgtgggtagacaatgatggcaactgtgctgccctggcggaaaggaaatttggccaaggaaagggactggaaaactttgttacacttatcacaggcacaggaatcggtggtggaattatccatcagcatgaattgatccacggaagctccttctgtgctgcagaactgggccaccttgttgtgtctctggatgggcctgattgttcctgtggaagccatgggtgcattgaagcatacgcctctggaatggccttgcagagggaggcaaaaaagctccatgatgaggacctgctcttggtggaagggatgtcagtgccaaaagatgaggctgtgggtgcgctccatctcatccaagctgcgaaacttggcaatgcgaaggcccagagcatcctaagaacagctggaacagctttgggtcttggggttgtgaacatcctccataccatgaatccctcccttgtgatcctctccggagtcctggccagtcactatatccacattgtcaaagacgtcattcgccagcaggccttgtcctccgtgcaggacgtggatgtggtggtttcggatttggttgaccccgccctgctgggtgctgccagcatggttctggactacacaacacgcaggatctactagacctccaggaacagacatggaccttctctccagagctcctgagtggaatcaagttcttgtctttaggatgaccgtttcttaacaatcaaatctggtattgaactgcaggtgactttggcagagaaatgttttcacttttggtctcctcttccagagtcacctttccccactccta

SEQ ID NO: 137232 - DNA, 5298 bp, Homo sapiens
  Payload ID: 6871
  Gene Symbol: GNE
  Gene Name: glucosamine (UDP-N-acetyl)-2-epimerase/N-acetylmannosamine kinase
  Uniprot ID: Q9Y223
  ENST ID: ENST00000396594
  CDS Start-End: 113-2374
agtctggaattcagatgcctattggtgactgctccgtggcagctaaaccaagaaaacagctgctctgctcattatttcaaaccacactagggtacagagctcgtgcttcgggatggaaacctatggttatctgcagagggagtcatgctttcaaggacctcatgaactctattttaagaacctctcaaaacgaaacaagcaaatcatggagaagaatggaaataaccgaaagctgcgggtttgtgttgctacttgtaaccgtgcagattattctaaacttgccccgatcatgtttggcattaaaaccgaacctgagttctttgaacttgatgttgtggtacttggctctcacctgatagatgactatggaaatacatatcgaatgattgaacaagatgactttgacattaacaccaggctacacacaattgtgaggggagaagatgaggcagccatggtggagtcagtaggcctggccctagtgaagctgccagatgtccttaatcgcctgaagcctgatatcatgattgttcatggagacaggtttgatgccctggctctggccacatctgctgccttgatgaacatccgaatccttcacattgaaggtggggaagtcagtgggaccattgatgactctatcagacatgccataacaaaactggctcattatcatgtgtgctgcacccgcagtgcagagcagcacctgatatccatgtgtgaggaccatgatcgcatccttttggcaggctgcccttcctatgacaaacttctctcagccaagaacaaagactacatgagcatcattcgcatgtggctaggtgatgatgtaaaatctaaagattacattgttgcactacagcaccctgtgaccactgacattaagcattccataaaaatgtttgaattaacattggatgcacttatctcatttaacaagcggaccctagtcctgtttccaaatattgacgcagggagcaaagagatggttcgagtgatgcggaagaagggcattgagcatcatcccaactttcgtgcagttaaacacgtcccatttgaccagtttatacagttggttgcccatgctggctgtatgattgggaacagcagctgtggggttcgagaagttggagcttttggaacacctgtgatcaacctgggaacacgtcagattggaagagaaacaggggagaatgttcttcatgtccgggatgctgacacccaagacaaaatattgcaagcactgcaccttcagtttggtaaacagtacccttgttcaaagatatatggggatggaaatgctgttccaaggattttgaagtttctcaaatctatcgatcttcaagagccactgcaaaagaaattctgctttcctcctgtgaaggagaatatctctcaagatattgaccatattcttgaaactctaagtgccttggccgttgatcttggcgggacgaacctccgagttgcaatagtcagcatgaagggtgaaatagttaagaagtatactcagttcaatcctaaaacctatgaagagaggattaatttaatcctacagatgtgtgtggaagctgcagcagaagctgtaaaactgaactgcagaattttgggagtaggcatttccacaggtggccgtgtaaatcctcgggaaggaattgtgctgcattcaaccaaactgatccaagagtggaactctgtggaccttaggacccccctttctgacactttgcatctccctgtgtgggtagacaatgatggcaactgtgctgccctggcggaaaggaaatttggccaaggaaagggactggaaaactttgttacacttatcacaggcacaggaatcggtggtggaattatccatcagcatgaattgatccacggaagctccttctgtgctgcagaactgggccaccttgttgtgtctctggatgggcctgattgttcctgtggaagccatgggtgcattgaagcatacgcctctggaatggccttgcagagggaggcaaaaaagctccatgatgaggacctgctcttggtggaagggatgtcagtgccaaaagatgaggctgtgggtgcgctccatctcatccaagctgcgaaacttggcaatgcgaaggcccagagcatcctaagaacagctggaacagctttgggtcttggggttgtgaacatcctccataccatgaatccctcccttgtgatcctctccggagtcctggccagtcactatatccacattgtcaaagacgtcattcgccagcaggccttgtcctccgtgcaggacgtggatgtggtggtttcggatttggttgaccccgccctgctgggtgctgccagcatggttctggactacacaacacgcaggatctactagacctccaggaacagacatggaccttctctccagagctcctgagtggaatcaagttcttgtctttaggatgaccgtttcttaacaatcaaatctggtattgaactgcaggtgactttggcagagaaatgttttcacttttggtctcctcttccagagtcacctttccccactcctatttttgtagatgctattctttctgatgtcttcttactaggggtcattttagctcaaaccctgtaagttacagtcacaattttctgtgccaaagcagctacaataatagagaggaagccttcttagaactctgcttactaatgtattaataccactgagaccttcaggccttgcctgggatatcacttcatcctgaagtttgcattaataatccttccaggccgggcacagtggctcacgcctgtaatcccagcactttgggaggccgaggcgggcggatcacgaggtcaggagatcgagaccgccctggctaacatggtgaaacatggtgaaaccccgtctctactaaaaatacaaaaaattagctgggtgtggtggcgggtcccagctactcgggaggctgaggcaggagaatggcatgaaccagggaggcggagctggcagtgaactgagaccgcaccactgcactccagcctgggtgacagagcaagactccatctcaaaaataataataataaataataataataataataataataataataatccttccagctgggcgcagtggctcacgcctgtaatcccaacattttgggaggccgagatgggcggatcacctgaggtcaggagttcaagaccagcctggccaacatggtgaaaccccatctctactaaaatacaaaaattagccgggcgtggtggcatgtgcctgtagtcccagctactcgggaggctgaggcaggagaattgcttgaacccgggaggcggaggttgcagtgagccgagatcatgccactgcactccaccctgggtgacagagcgagactccgtctacacacacacacacacacacacacacatccttcctcctctaaccccaaactaagatcacagaaggtgatccagtcagagaacagagggaaatcttaccaggaagggcttaagtacacttttttttaaaacagctttattgtttttaaagcctacaatttgataagccttgacatatgtatacctgtgaaagcatcaccacaatcaagacactggacatatctatcactcccccatctcagatatcccccctaatcctggataccatttgttgaaagatgttattactctagctgaacttacaagagactttagaccagggatctaaattacagtggccttagtgaccttgtccttatcttcttaggacagctgagaagccactgggacttagagcctttaaaaggagattaactgtcccaaaaggatctttgctactgaccagcagacacttcttccttcagtagcctttcatactgtgttgagtaacaccctagggtgtccattaaagttttgagttttacctagagcccagagccatgaatcaggattctgtctacatgattcgtgttttcattggtgtcaaaatacaaaagccaaagttctggctatgaattgttaacttggaagaaatactaactgccaccacttattaagtgcctactgtgtgccaggctctgaactaggtgcttcatatacattatcctaaattatctcaacatatgaggtaggtgttttaatttttattttatagaacttggtgtgtttgactgttaagctatggggctagagagagggtttgatcccaggtccctctgtgcttttgctgctgagccacacaacctctcatttcaaaaacactttcaaaatgctaacatattctaattcactctaggccaccaaaaactttaatactaatatctgatttgtaaatgacttaatgtatccttgaccctatcagctgaatttaatgaaatattcctctctgctgtgaaattttaccagtatagtatttggtctagtgacaggtgttctatttttttgagacgggtctcactctgtcacccaggctggagtgcagtggctcaatgcaacctctgccccccaagttcaagtgattctcctgcctcagcctcttgagtagctgggattacaggcacatgcaccacgcccggctgatttttttttgtatttttagtagacagggtttcaccatgttggccaggctggtcttgaactcctgacctcaggtgatccgcccgcctctgcctcccaaagtgctgggattacaggtgtaagccatcacacctggccctagtgacaggtttttatgggtacttttagatgatctaagaaatcatgtgcatatatctttcagatttctattttgggaaaatgaaggtttctacaacatattgtttcagtgttcaaataaactgaaggactcaacattacatttgaactatatccttcctagtgggttagtgtgaaaaagagtttggctgattcctaaaactctgccagccctgcagtaatctccagggcctggttattgttcagacattccatggtgattcctgggaaggaagcttggctgctcagtttctgagtctggggtgagataatgttctgggaagggacatctgttctttggtgtaatctctcatggtgaaatctgctctgtacatcagacaattgcattgctaccaagtttcataccaaatatttgaaaggatggtattgaatctaaaaccaaatattagtttttattaaactcatgggaaggctaatatattccaacgtaaattattacatatggttaagtaattgcatgttaatttattttaatgtaaatatttttgttactgttctgagccaaattctaaagaaaaaataaatacatttccttgttgaaa

SEQ ID NO: 137233 - DNA, 2174 bp, Homo sapiens
  Payload ID: 6871
  Gene Symbol: GNE
  Gene Name: glucosamine (UDP-N-acetyl)-2-epimerase/N-acetylmannosamine kinase
  Uniprot ID: Q9Y223
  ENST ID: ENST00000447283
  CDS Start-End: 52-1998
cggcgtctggaactctattttaagaacctctcaaaacgaaacaagcaaatcatggagaagaatggaaataaccgaaagctgcgggtttgtgttgctacttgtaaccgtgcagattattctaaacttgccccgatcatgtttggcattaaaaccgaacctgagttctttgaacttgatgttgtggtacttggctctcacctgatagatgactatggaaatacatatcgaatgattgaacaagatgactttgacattaacaccaggctacacacaattgtgaggggagaagatgaggcagccatggtggagtcagtaggcctggccctagtgaagctgccagatgtccttaatcgcctgaagcctgatatcatgattgttcatggagacaggtttgatgccctggctctggccacatctgctgccttgatgaacatccgaatccttcacattgaaggtggggaagtcagtgggaccattgatgactctatcagacatgccataacaaaactggctcattatcatgtgtgctgcacccgcagtgcagagcagcacctgatatccatgtgtgaggaccatgatcgcatccttttggcaggctgcccttcctatgacaaacttctctcagccaagaacaaagactacatgagcatcattcgcatgtggctaggtgatgatgtaaaatctaaagattacattgttgcactacagcaccctgtgaccactgacattaagcattccataaaaatgtttgaattaacattggatgcacttatctcatttaacaagcggaccctagtcctgtttccaaatattgacgcagggagcaaagagatggttcgagtgatgcggaagaagggcattgagcatcatcccaactttcgtgcagttaaacacgtcccatttgaccagtttatacagttggttgcccatgctggctgtatgattgggaacagcagctgtggggttcgagaagttggagcttttggaacacctgtgatcaacctgggaacacgtcagattggaagagaaacaggggagaatgttcttcatgtccgggatgctgacacccaagacaaaatattgcaagcactgcaccttcagtttggtaaacagtacccttgttcaaagatatatggggatggaaatgctgttccaaggattttgaagtttctcaaatctatcgatcttcaagagccactgcaaaagaaattctgctttcctcctgtgaaggagaatatctctcaagatattgaccatattcttgaaactctaagtgccttggccgttgatcttggcgggacgaacctccgagttgcaatagtcagcatgaagggtgaaatagttaagaagtatactcagttcaatcctaaaacctatgaagagaggattaatttaatcctacagatgtgtgtggaagctgcagcagaagctgtaaaactgaactgcagaattttgggagtaggaatcggtggtggaattatccatcagcatgaattgatccacggaagctccttctgtgctgcagaactgggccaccttgttgtgtctctggatgggcctgattgttcctgtggaagccatgggtgcattgaagcatacgcctctggaatggccttgcagagggaggcaaaaaagctccatgatgaggacctgctcttggtggaagggatgtcagtgccaaaagatgaggctgtgggtgcgctccatctcatccaagctgcgaaacttggcaatgcgaaggcccagagcatcctaagaacagctggaacagctttgggtcttggggttgtgaacatcctccataccatgaatccctcccttgtgatcctctccggagtcctggccagtcactatatccacattgtcaaagacgtcattcgccagcaggccttgtcctccgtgcaggacgtggatgtggtggtttcggatttggttgaccccgccctgctgggtgctgccagcatggttctggactacacaacacgcaggatctactagacctccaggaacagacatggaccttctctccagagctcctgagtggaatcaagttcttgtctttaggatgaccgtttcttaacaatcaaatctggtattgaactgcaggtgactttggcagagaaatgttttcacttttggtctcctcttccagagtcacctttccccactcctat

SEQ ID NO: 137234 - DNA, 2576 bp, Homo sapiens
  Payload ID: 6871
  Gene Symbol: GNE
  Gene Name: glucosamine (UDP-N-acetyl)-2-epimerase/N-acetylmannosamine kinase
  Uniprot ID: Q9Y223
  ENST ID: ENST00000543356
  CDS Start-End: 1-2154
atgcctattggtgactgctccgtggcagctaaaccaagaaaacagctgctctgctcattatttcaaaccacactagggtacagagctcgtgcttcgggatggaaacctatggttatctgcagagggagtcatgctttcaaggacctcataaatacatatcgaatgattgaacaagatgactttgacattaacaccaggctacacacaattgtgaggggagaagatgaggcagccatggtggagtcagtaggcctggccctagtgaagctgccagatgtccttaatcgcctgaagcctgatatcatgattgttcatggagacaggtttgatgccctggctctggccacatctgctgccttgatgaacatccgaatccttcacattgaaggtggggaagtcagtgggaccattgatgactctatcagacatgccataacaaaactggctcattatcatgtgtgctgcacccgcagtgcagagcagcacctgatatccatgtgtgaggaccatgatcgcatccttttggcaggctgcccttcctatgacaaacttctctcagccaagaacaaagactacatgagcatcattcgcatgtggctaggtgatgatgtaaaatctaaagattacattgttgcactacagcaccctgtgaccactgacattaagcattccataaaaatgtttgaattaacattggatgcacttatctcatttaacaagcggaccctagtcctgtttccaaatattgacgcagggagcaaagagatggttcgagtgatgcggaagaagggcattgagcatcatcccaactttcgtgcagttaaacacgtcccatttgaccagtttatacagttggttgcccatgctggctgtatgattgggaacagcagctgtggggttcgagaagttggagcttttggaacacctgtgatcaacctgggaacacgtcagattggaagagaaacaggggagaatgttcttcatgtccgggatgctgacacccaagacaaaatattgcaagcactgcaccttcagtttggtaaacagtacccttgttcaaagatatatggggatggaaatgctgttccaaggattttgaagtttctcaaatctatcgatcttcaagagccactgcaaaagaaattctgctttcctcctgtgaaggagaatatctctcaagatattgaccatattcttgaaactctaagtgccttggccgttgatcttggcgggacgaacctccgagttgcaatagtcagcatgaagggtgaaatagttaagaagtatactcagttcaatcctaaaacctatgaagagaggattaatttaatcctacagatgtgtgtggaagctgcagcagaagctgtaaaactgaactgcagaattttgggagtaggcatttccacaggtggccgtgtaaatcctcgggaaggaattgtgctgcattcaaccaaactgatccaagagtggaactctgtggaccttaggacccccctttctgacactttgcatctccctgtgtgggtagacaatgatggcaactgtgctgccctggcggaaaggaaatttggccaaggaaagggactggaaaactttgttacacttatcacaggcacaggaatcggtggtggaattatccatcagcatgaattgatccacggaagctccttctgtgctgcagaactgggccaccttgttgtgtctctggatgggcctgattgttcctgtggaagccatgggtgcattgaagcatacgcctctggaatggccttgcagagggaggcaaaaaagctccatgatgaggacctgctcttggtggaagggatgtcagtgccaaaagatgaggctgtgggtgcgctccatctcatccaagctgcgaaacttggcaatgcgaaggcccagagcatcctaagaacagctggaacagctttgggtcttggggttgtgaacatcctccataccatgaatccctcccttgtgatcctctccggagtcctggccagtcactatatccacattgtcaaagacgtcattcgccagcaggccttgtcctccgtgcaggacgtggatgtggtggtttcggatttggttgaccccgccctgctgggtgctgccagcatggttctggactacacaacacgcaggatctactagacctccaggaacagacatggaccttctctccagagctcctgagtggaatcaagttcttgtctttaggatgaccgtttcttaacaatcaaatctggtattgaactgcaggtgactttggcagagaaatgttttcacttttggtctcctcttccagagtcacctttccccactcctatttttgtagatgctattctttctgatgtcttcttactaggggtcattttagctcaaaccctgtaagttacagtcacaattttctgtgccaaagcagctacaataatagagaggaagccttcttagaactctgcttactaatgtattaataccactgagaccttcaggccttgcctgggatatcacttcatcctgaagtttgcattaataatccttccaggccgggcacagtggctcacgcctgtaat

SEQ ID NO: 137235 - DNA, 3657 bp, Homo sapiens
  Payload ID: 6871
  Gene Symbol: GNE
  Gene Name: glucosamine (UDP-N-acetyl)-2-epimerase/N-acetylmannosamine kinase
  Uniprot ID: Q9Y223
  ENST ID: ENST00000539815
  CDS Start-End: 42-2210
aactctattttaagaacctctcaaaacgaaacaagcaaatcatggagaagaatggaaataaccgaaagctgcgggtttgtgttgctacttgtaaccgtgcagattattctaaacttgccccgatcatgtttggcattaaaaccgaacctgagttctttgaacttgatgttgtggtacttggctctcacctgatagatgactatggaaatacatatcgaatgattgaacaagatgactttgacattaacaccaggctacacacaattgtgaggggagaagatgaggcagccatggtggagtcagtaggcctggccctagtgaagctgccagatgtccttaatcgcctgaagcctgatatcatgattgttcatggagacaggtttgatgccctggctctggccacatctgctgccttgatgaacatccgaatccttcacattgaaggtggggaagtcagtgggaccattgatgactctatcagacatgccataacaaaactggctcattatcatgtgtgctgcacccgcagtgcagagcagcacctgatatccatgtgtgaggaccatgatcgcatccttttggcaggctgcccttcctatgacaaacttctctcagccaagaacaaagactacatgagcatcattcgcatgtggctaggtgatgatgtaaaatctaaagattacattgttgcactacagcaccctgtgaccactgacattaagcattccataaaaatgtttgaattaacattggatgcacttatctcatttaacaagcggaccctagtcctgtttccaaatattgacgcagggagcaaagagatggttcgagtgatgcggaagaagggcattgagcatcatcccaactttcgtgcagttaaacacgtcccatttgaccagtttatacagttggttgcccatgctggctgtatgattgggaacagcagctgtggggttcgagaagttggagcttttggaacacctgtgatcaacctgggaacacgtcagattggaagagaaacaggggagaatgttcttcatgtccgggatgctgacacccaagacaaaatattgcaagcactgcaccttcagtttggtaaacagtacccttgttcaaagatatatggggatggaaatgctgttccaaggattttgaagtttctcaaatctatcgatcttcaagagccactgcaaaagaaattctgctttcctcctgtgaaggagaatatctctcaagatattgaccatattcttgaaactctaagtgccttggccgttgatcttggcgggacgaacctccgagttgcaatagtcagcatgaagggtgaaatagttaagaagtatactcagttcaatcctaaaacctatgaagagaggattaatttaatcctacagatgtgtgtggaagctgcagcagaagctgtaaaactgaactgcagaattttgggagtaggcatttccacaggtggccgtgtaaatcctcgggaaggaattgtgctgcattcaaccaaactgatccaagagtggaactctgtggaccttaggacccccctttctgacactttgcatctccctgtgtgggtagacaatgatggcaactgtgctgccctggcggaaaggaaatttggccaaggaaagggactggaaaactttgttacacttatcacaggcacaggaatcggtggtggaattatccatcagcatgaattgatccacggaagctccttctgtgctgcagaactgggccaccttgttgtgtctctggatgggcctgattgttcctgtggaagccatgggtgcattgaagcatacgcctctggaatggccttgcagagggaggcaaaaaagctccatgatgaggacctgctcttggtggaagggatgtcagtgccaaaagatgaggctgtgggtgcgctccatctcatccaagctgcgaaacttggcaatgcgaaggcccagagcatcctaagaacagctggaacagctttgggtcttggggttgtgaacatcctccataccatgaatccctcccttgtgatcctctccggagtcctggccagtcactatatccacattgtcaaagacgtcattcgccagcaggccttgtcctccgtgcaggacgtggatgtggtggtttcggatttggttgaccccgccctgctgggtgctgccagcatggttctggactacacaacacgcaggatctactagacctccaggaacagacatggaccttctctccagagctcctgagtggaatcaagttcttgtctttaggatgaccgtttcttaacaatcaaatctggtattgaactgcaggtgactttggcagagaaatgttttcacttttggtctcctcttccagagtcacctttccccactcctatttttgtagatgctattctttctgatgtcttcttactaggggtcattttagctcaaaccctgtaagttacagtcacaattttctgtgccaaagcagctacaataatagagaggaagccttcttagaactctgcttactaatgtattaataccactgagaccttcaggccttgcctgggatatcacttcatcctgaagtttgcattaataatccttccaggccgggcacagtggctcacgcctgtaatcccagcactttgggaggccgaggcgggcggatcacgaggtcaggagatcgagaccgccctggctaacatggtgaaacatggtgaaaccccgtctctactaaaaatacaaaaaattagctgggtgtggtggcgggtcccagctactcgggaggctgaggcaggagaatggcatgaaccccaggctggagtgcagtggctcaatgcaacctctgccccccaagttcaagtgattctcctgcctcagcctcttgagtagctgggattacaggcacatgcaccacgcccggctgatttttttttgtatttttagtagacagggtttcaccatgttggccaggctggtcttgaactcctgacctcaggtgatccgcccgcctctgcctcccaaagtgctgggattacaggtgtaagccatcacacctggccctagtgacaggtttttatgggtacttttagatgatctaagaaatcatgtgcatatatctttcagatttctattttgggaaaatgaaggtttctacaacatattgtttcagtgttcaaataaactgaaggactcaacattacatttgaactatatccttcctagtgggttagtgtgaaaaagagtttggctgattcctaaaactctgccagccctgcagtaatctccagggcctggttattgttcagacattccatggtgattcctgggaaggaagcttggctgctcagtttctgagtctggggtgagataatgttctgggaagggacatctgttctttggtgtaatctctcatggtgaaatctgctctgtacatcagacaattgcattgctaccaagtttcataccaaatatttgaaaggatggtattgaatctaaaaccaaatattagtttttattaaactcatgggaaggctaatatattccaacgtaaattattacatatggttaagtaattgcatgttaatttattttaatgtaaatatttttgttactgttctgagccaaattctaaagaaaaaataaatacatttccttgttg

SEQ ID NO: 137236 - DNA, 2190 bp, Homo sapiens
  Payload ID: 6871
  Gene Symbol: GNE
  Gene Name: glucosamine (UDP-N-acetyl)-2-epimerase/N-acetylmannosamine kinase
  Uniprot ID: Q9Y223
  ENST ID: ENST00000539208
  CDS Start-End: 139-1977
tacccgcgcgcccgagcgcggaaaccgaggggcaggctcgcgctctgcctgcttcgtggcgcttggttcgtccctcgcccgaggagcgcggtggcggcgtgggagggagcctctgacggcgtctgaaatacatatcgaatgattgaacaagatgactttgacattaacaccaggctacacacaattgtgaggggagaagatgaggcagccatggtggagtcagtaggcctggccctagtgaagctgccagatgtccttaatcgcctgaagcctgatatcatgattgttcatggagacaggtttgatgccctggctctggccacatctgctgccttgatgaacatccgaatccttcacattgaaggtggggaagtcagtgggaccattgatgactctatcagacatgccataacaaaactggctcattatcatgtgtgctgcacccgcagtgcagagcagcacctgatatccatgtgtgaggaccatgatcgcatccttttggcaggctgcccttcctatgacaaacttctctcagccaagaacaaagactacatgagcatcattcgcatgtggctagggagcaaagagatggttcgagtgatgcggaagaagggcattgagcatcatcccaactttcgtgcagttaaacacgtcccatttgaccagtttatacagttggttgcccatgctggctgtatgattgggaacagcagctgtggggttcgagaagttggagcttttggaacacctgtgatcaacctgggaacacgtcagattggaagagaaacaggggagaatgttcttcatgtccgggatgctgacacccaagacaaaatattgcaagcactgcaccttcagtttggtaaacagtacccttgttcaaagatatatggggatggaaatgctgttccaaggattttgaagtttctcaaatctatcgatcttcaagagccactgcaaaagaaattctgctttcctcctgtgaaggagaatatctctcaagatattgaccatattcttgaaactctaagtgccttggccgttgatcttggcgggacgaacctccgagttgcaatagtcagcatgaagggtgaaatagttaagaagtatactcagttcaatcctaaaacctatgaagagaggattaatttaatcctacagatgtgtgtggaagctgcagcagaagctgtaaaactgaactgcagaattttgggagtaggcatttccacaggtggccgtgtaaatcctcgggaaggaattgtgctgcattcaaccaaactgatccaagagtggaactctgtggaccttaggacccccctttctgacactttgcatctccctgtgtgggtagacaatgatggcaactgtgctgccctggcggaaaggaaatttggccaaggaaagggactggaaaactttgttacacttatcacaggcacaggaatcggtggtggaattatccatcagcatgaattgatccacggaagctccttctgtgctgcagaactgggccaccttgttgtgtctctggatgggcctgattgttcctgtggaagccatgggtgcattgaagcatacgcctctggaatggccttgcagagggaggcaaaaaagctccatgatgaggacctgctcttggtggaagggatgtcagtgccaaaagatgaggctgtgggtgcgctccatctcatccaagctgcgaaacttggcaatgcgaaggcccagagcatcctaagaacagctggaacagctttgggtcttggggttgtgaacatcctccataccatgaatccctcccttgtgatcctctccggagtcctggccagtcactatatccacattgtcaaagacgtcattcgccagcaggccttgtcctccgtgcaggacgtggatgtggtggtttcggatttggttgaccccgccctgctgggtgctgccagcatggttctggactacacaacacgcaggatctactagacctccaggaacagacatggaccttctctccagagctcctgagtggaatcaagttcttgtctttaggatgaccgtttcttaacaatcaaatctggtattgaactgcaggtgactttggcagagaaatgttttcacttttggtctcctcttccagagtcacctttccccactcctatttttgtagatgctattctttctgatgtcttcttacta

SEQ ID NO: 137237 - DNA, 2273 bp, Homo sapiens
  Payload ID: 6872
  Gene Symbol: GNPDA1
  Gene Name: glucosamine-6-phosphate deaminase 1
  Uniprot ID: P46926
  ENST ID: ENST00000311337
  CDS Start-End: 44-913
cggcgcagtcgctgcagccgccgcgggaggcgtccgtgacaagatgaagctcatcatcctggagcactattctcaggcgagcgagtgggcggctaaatacatcaggaaccgcatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctctttgaagagtcttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaagcctcactgtggctcctctgttttacatactcattagtaagtgggaggtccactggggcaacagacactgccacaatttcagtgttgtgttcagccaaggggacggtctgggcaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtgttttgtctttagcttttctatgtgattgtgccgtcattctgttttaagctcatggatcaatggatttgtttacaatgtgatattttctattaaatccagtattttcaaataaca

SEQ ID NO: 137238 - DNA, 925 bp, Homo sapiens
  Payload ID: 6872
  Gene Symbol: GNPDA1
  Gene Name: glucosamine-6-phosphate deaminase 1
  ENST ID: ENST00000505689
  CDS Start-End: 54-925
gccgggccgccggcgcagtcgctgcagccgccgcgggaggcgtccgtgacaagatgaagctcatcatcctggagcactattctcaggcgagcgagtgggcggctaaatacatcaggaaccgcatcatccagtttaacccagggccagagaagtacttcaccctggggctccccactggtgcgttcttggatggagagggtgccgtggataagggtggagagagtaggcaacaggggccagggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgta

SEQ ID NO: 137239 - DNA, 543 bp, Homo sapiens
  Payload ID: 6872
  Gene Symbol: GNPDA1
  Gene Name: glucosamine-6-phosphate deaminase 1
  ENST ID: ENST00000503229
  CDS Start-End: 130-543
gcagtcgctgcagccgccgcgggaggcgtccgttctgtgaagtaggtactattgtcccaatttttacataggaggaaacggctcagagagaacttaggtcctttgaccgaggtcctgcaggtggacaagatgaagctcatcatcctggagcactattctcaggcgagcgagtgggcggctaaatacatcaggaaccgcatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatc

SEQ ID NO: 137240 - DNA, 2622 bp, Homo sapiens
  Payload ID: 6872
  Gene Symbol: GNPDA1
  Gene Name: glucosamine-6-phosphate deaminase 1
  Uniprot ID: P46926
  ENST ID: ENST00000503794
  CDS Start-End: 402-1271
cggggaccttcctcgcgggccggagcgcggagcgctgccccagccctacggcactcggggtcgggaccccggggagccgccctcacacattttccaggagggatcggaggggcgatggggtggtaatgggggtgggggacacgctgtaccccaccgacgaccgcgcgggccaccttcgcctctttccttcacactcccactaaccgcagtgctgggggaacaaaatgtcctccttctggagcgattaccttttcccttttgtgctttgggggaaactgaagacccagaggggttcgcaaagcaagtctgtgaagtaggtactattgtcccaatttttacataggaggaaacggctcagagagaacttaggtcctttgaccgaggtcctgcaggtggacaagatgaagctcatcatcctggagcactattctcaggcgagcgagtgggcggctaaatacatcaggaaccgcatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctctttgaagagtcttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaagcctcactgtggctcctctgttttacatactcattagtaagtgggaggtccactggggcaacagacactgccacaatttcagtgttgtgttcagccaaggggacggtctgggcaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtgttttgtctttagcttttctatgtgattgtgccgtcattctgttttaagctcatggatcaatggatttgtttacaatgtgatattttctattaaatccagtatttt

SEQ ID NO: 137241 - DNA, 980 bp, Homo sapiens
  Payload ID: 6872
  Gene Symbol: GNPDA1
  Gene Name: glucosamine-6-phosphate deaminase 1
  ENST ID: ENST00000513454
  CDS Start-End: 40-864
gcagtcgctgcagccgccgcgggaggcgtccgtgacaagatgaagctcatcatcctggagcactattctcaggcgagcgagtgggcggctaaatacatcaggaaccgcatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaagctcctccacaggtcaacaggaagggatacatctactcaacaaacttcgggatttagccaagatggcaggctaattctcacaccagggcacagtctaatgggtccagctgacttcctgacttgatcaacttgcccagtgtttaatgatgtttttcaagaagccgagcaggaaa

SEQ ID NO: 137242 - DNA, 2980 bp, Homo sapiens
  Payload ID: 6872
  Gene Symbol: GNPDA1
  Gene Name: glucosamine-6-phosphate deaminase 1
  Uniprot ID: P46926
  ENST ID: ENST00000508177
  CDS Start-End: 760-1629
ctctttccttcacactcccactaaccgcagtgctgggggaacaaaatgtcctccttctggagcgattaccttttcccttttgtgctttgggggaaactgaagacccagaggggttcgcaaagcaaggtgggccagtaggaagacccctccgctagtccagagagagcacacagctccccaggcagagctcattgccccacctgctctagtggcccagcatgatcccatgacctctctacttctggaggaagagtcttggggtagacggcggggagggggtagggtatcccgttccggtaggggcagggatgagggaggcggggctgagccgagcatctatctggatggtaacagccaacgtagaaaatactaagttgtttacatgcattctctcatttcatattacccgtcgtgaagtctgtgaagtaggtactattgtcccaatttttacataggaggaaacggctcagagagaacttaggtcctttgaccgaggtcctgcaggtggtaagtgaaggagctgagattagaacccagatctgcccccagtggcgcctcctcgtggtctgtgggtggtggagacgactggcctagcctcttagctcctctgtgaatagaaaggcctttttcctggctcagacagcttgggaaggggattgttgctgggtaagagaagcttctcccaccacctccatctctttctctgccccttaccattgattcctttctgtcatcccctctcccccactgcaggacaagatgaagctcatcatcctggagcactattctcaggcgagcgagtgggcggctaaatacatcaggaaccgcatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctctttgaagagtcttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaagcctcactgtggctcctctgttttacatactcattagtaagtgggaggtccactggggcaacagacactgccacaatttcagtgttgtgttcagccaaggggacggtctgggcaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtgttttgtctttagcttttctatgtgattgtgccgtcattctgttttaagctcatggatcaatggatttgtttacaatgtgatattttctattaaatccagtatttt

SEQ ID NO: 137243 - DNA, 2319 bp, Homo sapiens
  Payload ID: 6872
  Gene Symbol: GNPDA1
  Gene Name: glucosamine-6-phosphate deaminase 1
  Uniprot ID: P46926
  ENST ID: ENST00000500692
  CDS Start-End: 95-964
ggcgcagtcgctgcagccgccgcgggaggcgtccgtgaggaaacggctcagagagaacttaggtcctttgaccgaggtcctgcaggtggacaagatgaagctcatcatcctggagcactattctcaggcgagcgagtgggcggctaaatacatcaggaaccgcatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtgatgatccttatcacaggtgctcacaaggcatttgctctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctctttgaagagtcttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaagcctcactgtggctcctctgttttacatactcattagtaagtgggaggtccactggggcaacagacactgccacaatttcagtgttgtgttcagccaaggggacggtctgggcaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtgttttgtctttagcttttctatgtgattgtgccgtcattctgttttaagctcatggatcaatggatttgtttacaatgtgatattttctattaaatccagtattttcaaa

SEQ ID NO: 137244 - DNA, 570 bp, Homo sapiens
  Payload ID: 6872
  Gene Symbol: GNPDA1
  Gene Name: glucosamine-6-phosphate deaminase 1
  ENST ID: ENST00000510194
  CDS Start-End: 89-570
gtgtaagtgggtagcagggctggcggggaccttcctcgcgggccggagcgcggagcgctgccccagccctacggcactcggggacaagatgaagctcatcatcctggagcactattctcaggcgagcgagtgggcggctaaatacatcaggaaccgcatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagac

SEQ ID NO: 137245 - DNA, 754 bp, Homo sapiens
  Payload ID: 6872
  Gene Symbol: GNPDA1
  Gene Name: glucosamine-6-phosphate deaminase 1
  ENST ID: ENST00000504139
  CDS Start-End: 44-754
cggcgcagtcgctgcagccgccgcgggaggcgtccgtgacaagatgaagctcatcatcctggagcactattctcaggcgagcgagtgggcggctaaatacatcaggaaccgcatcatccagtttaacccagggccagagaagtacttcaccctggggctccccactgggagtaccccacttggctgctacaagaagctgattgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaacacccacattctggatgggaatgcagtcgacctacaggcagaatgtgatgcctttgaagagaagatcaaggctgcaggtgggatcgagctatttgttggaggcatcggccctgatggacacattgccttcaacgagccaggctccagtctggtgtccaggacccgtgtgaagacgctggccatggataccatcctggccaatgctaggttcttcgatggagaactcaccaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagt

SEQ ID NO: 137246 - DNA, 473 bp, Homo sapiens
  Payload ID: 6872
  Gene Symbol: GNPDA1
  Gene Name: glucosamine-6-phosphate deaminase 1
  ENST ID: ENST00000504424
  CDS Start-End: 387-473
gtgtaagtgggtagcagggctggcggggaccttcctcgcgggccggagcgcggagcgctgccccagccctacggcactcggggtcgggaccccggggagccgccctcacacattttccaggagggatcggaggggcgatggggtggtaatgggggtgggggacacgctgtaccccaccgacgaccgcgcgggccaccttcgcctctttccttcacactcccactaaccgcagtgctgggggaacaaaatgtcctccttctggagcgattaccttttcccttttgtgctttgggggaaactgaagacccagaggggttcgcaaagcaaggaggaaacggctcagagagaacttaggtcctttgaccgaggtcctgcaggtggacaagatgaagctcatcatcctggagcactattctcaggcgagcgagtgggcggctaaatacatcaggaaccgcatcatccagtttaaccca

SEQ ID NO: 137247 - DNA, 1930 bp, Homo sapiens
  Payload ID: 6873
  Gene Symbol: GNPDA2
  Gene Name: glucosamine-6-phosphate deaminase 2
  Uniprot ID: Q8TDQ7
  ENST ID: ENST00000295448
  CDS Start-End: 158-988
cgcctttatctgcatccgggtccgtgggattcgcgctccactggtcagctggggtcgctctcgggtggttgggtgttgcttgttcccgctgttccagcatcgaagaaccattgggtctgccggtttgaacttgttctggaagctgtgcgtcaccgtaatgaggcttgtaattcttgataactatgacttggctagtgaatgggcagccaaatacatctgtaatcgcatcattcagttcaaacctggacaggacagatattttacactgggtttaccaacagggagtacacctttaggatgctataaaaaactaatagaatatcataagaatggacacctttcttttaaatatgtgaagacctttaatatggatgaatatgtaggacttccaagaaatcatcctgaaagctaccattcttatatgtggaataatttttttaagcatatcgatatagatcctaataatgcacatatccttgacgggaatgctgcagatttacaagcagaatgtgatgcttttgaaaacaaaataaaagaagctggaggaatagatctttttgttggaggaattggtccagatggtcatatcgctttcaatgagcctggatccagtttagtgtcaaggacaagattaaagactctagcaatggataccatcttggcaaatgccaaatattttgatggagatttatcaaaagtgccaactatggctctaactgttggtgtggggacagtgatggatgctagagaagtaatgatccttataacaggggcacacaaggcatttgccctgtacaaagcaatagaagaaggagtcaatcacatgtggactgtttccgctttccagcagcatccccggactatttttgtatgcgatgaagatgctactttagaattaagagttaaaactgtgaaatactttaaaggtctaatgcatgtgcacaataaacttgtggatccactattcagtatgaaagatggaaactgaaggagactggagcaaaattcagcttgaatgaacagagcactttttactaagtagtagatgaattttcagctatgcaatatgacaaaacatggggaattttgaagattgtcattttttcattcgagtctctatgttaaacattccatattttgaatatttatatcttgtacttgggtttaagagaagtagctggctctcaagattgactggctatttattataaagtactgaagtcacatagccacctataaaacagcatagaaatgtctgcctgtttaaaaagtcattttaaaggtagagtgtccacatcaggcaccatttgtgatatgactccagtggcgtatatttcattttttaatgacaagacactccaaacctttcagataacaaactatcattgcagaccttcacttttggaatgcaatctttatattttctgtgcatcacacacatgcttttctgcacgtggttgccttagtcatcttcctacagcaccatctagacatcaaaaattgtgctatatatcattggtaaaggaaatttgaagagatgacagtgcctaaaagtacagtttacatccttttggaaagtatgtgtaagtgcatgttttttgtgcaccttcttctatagcacttttttacaaatatcttatttttatttaacgacttgggttcatgtccctaatataagtatcttgacaattatgagctttatacctagcaagccacttcaggaaattcttttggagaatattttctgattattgttaaacttaatatacaattagctttattccttataaaatgtctaaaagaataatacgaagtatatataaaaggaattactgtaaactacattgccatagcaatttacataaaagtatattgttttttatctttaactcaaataaagcgtgtaataaataagttatctaaatttcca

SEQ ID NO: 137248 - DNA, 5382 bp, Homo sapiens
  Payload ID: 6873
  Gene Symbol: GNPDA2
  Gene Name: glucosamine-6-phosphate deaminase 2
  Uniprot ID: Q8TDQ7
  ENST ID: ENST00000509756
  CDS Start-End: 108-887
ggggtcgctctcgggtggttgggtgttgcttgttcccgctgttccagcatcgaagaaccattgggtctgccggtttgaacttgttctggaagctgtgcgtcaccgtaatgaggcttgtaattcttgataactatgacttggctagtgaatgggcagccaaatacatctgtaatcgcatcattcagttcaaacctggacaggacagatattttacactgggtttaccaacagggagtacacctttaggatgctataaaaaactaatagaatatcataagaatggacacctttcttttaaatatgtgaagacctttaatatggatgaatatgtaggacttccaagaaatcatcctgaaagctaccattcttatatgtggaataatttttttaagcatatcgatatagatcctaataatgcacatatccttgacgggaatgctgcagatttacaagcagaatgtgatgcttttgaaaacaaaataaaagaagctggaggaatagatctttttgttggaggaattggtccagatggtcatatcgctttcaatgagcctggatccagtttagtgtcaaggacaagattaaagactctagcaatggataccatcttggcaaatgccaaatattttgatggagatttatcaaaagtgccaactatggctctaactgttggtgtggggacagtgatggatgctagagaagtaatgatccttataacaggggcacacaaggcatttgccctgtacaaagcaatagaagaaggagtcaatcacatgtggactgtttccgctttccagcagcatccccggactatttttgtatgcgatgaagatgctactttagaattaagagttaaaactgtgaaatactttaaaggtgagcactgaatttcaaaagccgactgagataatctgttgtgagtgacaattaaaacttactgtgactgtggggttaaatctcacactgtgacctattgaaaagtggcaacacatagctagttctttcaagtaatggaaagttctcacctcagataatagtatcttcaaagtagtacctttttttttttttcatgaagagaatctcttcagtctctattttcagtaaacaatttttcttgaaatccaaggtttaataatttactttcatattgaatatacaagaccaaataacccaaaagaaaatgtatctttgtccattctggatttcttttcatgtttactagtcccacctcaatccctcttcctcactcccctctaaccttaatttagaacctaatcagtggataagagatctcccactatctaatttaatctttacaattttaagccaatttattcccatatattaaagttataatgtctaaatgttaaaatagtatggaataaactctgcaagtaagcaggagtttgattgcccagacttcatgttgattttcctttttcctgtagtctagttcagtaattcagaaaccttactctaccaggctgtgtattacaaaacacatatgcttgatataatggttttaagagattttcaagggacattttgcctatacccaatgtagaacctattctctgatttaagagtcagctccacatattacacatatgtaagcaaactgtacaaacaggtaattttcataaagcacctgtatttacatagctgatattaaaagttacatagttgatcatatagataggtcagtgattcactatgtagtatgtatgctacttttgctacatgattataccttttaatcttttttactctagtaactaggtatttattttaatgcctattggaaaatacactgaataaatcaaagctatattttttggatattattgcttaagacaaggtccaaaaaagctaccatatttgattggctctaatacacgttgatcttgctgatgttggactgtgtcttaaaactggtgtcagatcatagcttactgggtagcatttttttctcagtggtacataaaatggtgtgtcttacaatttatagcatctcatactcagaaataaagtatataatcttaaatttttaattcaatgcaaagaaaaccaactcatatttcatgtatatgtgtgaatatggcaaatatcttgaaggtgttatacaaataactgacatttggcaagcactgaaaatagtctatttttaaacaaaatgctgatcatgctttgtatatagttttgtatttgtacttatgtttcatgagcattttcctgttttactaaatatttggaagcattttaatggatagttaagtacataaatcataatttatttaaacatttccttattaacacttagattatttctagtcatttatatttttaccatttaaattactaatttaccaagccacaaatatatcaaactgaaaaactgaaaaactgaaaaatttctgatttgtgaataaaagagcatttgatggagttttaactctattttcccatgtaacccttcagatttcatcccaaataatagattccttgactacaaggaatcctcactatccacaaattttaattccagttttaaggagattcatttaacatggccattttctagtcctcattaagtcccagataaatccctgtactaatctaattttgtcacaattaggtttttatcagatttttatatcttggtgaatatttaataagatatttaataacagccagtatctctatgaccaggcactattctaaatgcattttacttattgatttacttatcacaaaaatgttatgaaatgggtattcatagtcccatttttaaattaataggcttaacagacagagacgttaagctacttacccaaagtcatacagcacatatttgggcagagctgggtaatagaaatcaaaatcaggctgatctctggagtatgcaggcttttgtctattctattatactgcctcccagaataaactctaggtatgataccatctacatcaaaaccatatttccatctgcttttttcccatatgataatcactgcttccaaaaaaggtatatcgacatatgttagataatttaaaatagaagggtggtagatgtttatatgtatttagttcttttagttcatctaattgtaagctcttctgaaaaattttgaaacagaccattcgtgagaggatagctgcactgcatcaagaggacacagtattttccactttggagctgtctgtatttctgaagaggtttcagggtatcagcctgttaggatacctccttcaatatgaagacagaatttagacattctgggctacatatgggcctcattttacagcattttagtaaagggtagagaaattgaatattcttaaataaacacatttcaaatgtagtttgtatacttttcatacctccattgagttactagtatatcaaaatactggaggatgtaaattcctataattgtcatccataactcttcaaattccattcacatcactaccctttcttctgtcatcactaaaaagtgctgaccagaatcttaaagggttttatttagtgcctagataagatctaggttaactagatccaaaacaataaaaattgtcagtaaatgcaagtttatttcaatatatacctatataacggtatataccttttgaaagatacaagttaatcacaagacaacaagtttagtacgtggggatttgttttattcattctcgcttttcatttttgctttttaaatagaacagctttgatttttagtatatgacatcatcatcatgaatttttttctcttactttgtatttaggctccacctcagtagtttgacaaaggtagaatgagttcattttgagtcaaaaccataaaagttactttgtatagacattggttagaatctgtgacatttaacctttcttctggtaacgtttcaggaagtctggtgcatttttatcagaagaattatttctgtttgacttaagtagcaattatttatttatataaaattcgtatgtagaaagttgtcagtttttacctaaagtcacagtaaatatttgacttaatatctaaaaagcaattaatagaattttcaaaataattatttctagtttggaagcagtcctatttgatgtataaaagatatatccaatgtaaagaaaaaaattttataaaggagttgaatttttaatatttactgatattttaatttgcatgtattttaaagctctgtgtattctttccgtaatcaaagttgttagcaaatgacagatgaatactatttaagtagaaaaacgatcctctacaaagtgatactctggaaaatgttgcatcttctaaatcatacagctgatattacccttatctttgttgtcccctctcctactggacatgaagtttcaggtgaccttcaagtaggctgttgagcagttgcaggactagtgaatggaatgcttcccccttccctcctttagagtcccattcttatggttagaatttctcctactacacaaacacttcccagtactctttgcttgtcccttaaaagtgggtctttctcaaagctgggattttagagtcctttttgcagcctttctgacaaggaacatctgtttactaacaagcaacctatctctccaatccagtaatcccatttcctgcaaaaccgcattaagtgcctttccccaccctcccatgttcttaatacctggaaaacttaactcatttctttaccctccaaaatataaaatctctggttcattaactgggtcagtctttttagaacttttttctccccaaagaaatatagtactgaggcattaaaacaggagtaactggaagatcagctatttcccaagcagcttccatagctaagagcagtctgcaagtatatgtaccaattacaaaatgaaagttataatctaccggatttaaaatcgtaatttctattctgaattaaatgatttaatacaggttgttttctgtcttgttttagtaaccctccctcagtgtagaatttgtaatcaacctttgtcataaatacacatgccaaactattggaaagtaatttaccagacgaatggatagggtaatgtattaagagtgagacagcagttctgagcccctggctggagtctagtagaggaactgccagaggatcaatatcaacatagacttttagatataattaaaacctattatctaagtcagtattcaaatttgtcatgcttaatctctttgaagacaagaaatgctcttctggttactcccaaagtacctgtacacattctagatctgcactgttacataattataaattggtatttgctaggtagataaaacttaagacattctgaaacatttctatttgtactttttcaataaacttgactatatcaagatgggaact

SEQ ID NO: 137249 - DNA, 2074 bp, Homo sapiens
  Payload ID: 6873
  Gene Symbol: GNPDA2
  Gene Name: glucosamine-6-phosphate deaminase 2
  Uniprot ID: Q8TDQ7
  ENST ID: ENST00000507917
  CDS Start-End: 133-861
gggattcgcgctccactggtcagctggggtcgctctcgggtggttgggtgttgcttgttcccgctgttccagcatcgaagaaccattgggtctgccggtttgaacttgttctggaagctgtgcgtcaccgtaatgaggcttgtaattcttgataactatgacttggctagtgaatgggcagccaaatacatctgtaatcgcatcattcagttcaaacctggacaggacagatattttacactgggtttaccaacaggacttccaagaaatcatcctgaaagctaccattcttatatgtggaataatttttttaagcatatcgatatagatcctaataatgcacatatccttgacgggaatgctgcagatttacaagcagaatgtgatgcttttgaaaacaaaataaaagaagctggaggaatagatctttttgttggaggaattggtccagatggtcatatcgctttcaatgagcctggatccagtttagtgtcaaggacaagattaaagactctagcaatggataccatcttggcaaatgccaaatattttgatggagatttatcaaaagtgccaactatggctctaactgttggtgtggggacagtgatggatgctagagaagtaatgatccttataacaggggcacacaaggcatttgccctgtacaaagcaatagaagaaggagtcaatcacatgtggactgtttccgctttccagcagcatccccggactatttttgtatgcgatgaagatgctactttagaattaagagttaaaactgtgaaatactttaaaggtctaatgcatgtgcacaataaacttgtggatccactattcagtatgaaagatggaaactgaaggagactggagcaaaattcagcttgaatgaacagagcactttttactaagtagtagatgaattttcagctatgcaatatgacaaaacatggggaattttgaagattgtcattttttcattcgagtctctatgttaaacattccatattttgaatatttatatcttgtacttgggtttaagagaagtagctggctctcaagattgactggctatttattataaagtactgaagtcacatagccacctataaaacagcatagaaatgtctgcctgtttaaaaagtcattttaaaggtagagtgtccacatcaggcaccatttgtgatatgactccagtggcgtatatttcattttttaatgacaagacactccaaacctttcagataacaaactatcattgcagaccttcacttttggaatgcaatctttatattttctgtgcatcacacacatgcttttctgcacgtggttgccttagtcatcttcctacagcaccatctagacatcaaaaattgtgctatatatcattggtaaaggaaatttgaagagatgacagtgcctaaaagtacagtttacatccttttggaaagtatgtgtaagtgcatgttttttgtgcaccttcttctatagcacttttttacaaatatcttatttttatttaacgacttgggttcatgtccctaatataagtatcttgacaattatgagctttatacctagcaagccacttcaggaaattcttttggagaatattttctgattattgttaaacttaatatacaattagctttattccttataaaatgtctaaaagaataatacgaagtatatataaaaggaattactgtaaactacattgccatagcaatttacataaaagtatattgttttttatctttaactcaaataaagcgtgtaataaataagttatctaaatttccagaagtgaacctgaagaatacatgcattcgactcccaacaattatagtacatgtgaacctgcattcattttgggtttgttaccatcatgcattaggagagttaggttaaaagatgtctttgcctctgtggggagcaaaaaaatgctccttttgcttattttgcatttcataagcccacctggtagaagaagccttacttatctgcttgtctatgtgattaaaatgtagtttcttaaaatattaaaatagcaaataaattaatgaaataaaat

SEQ ID NO: 137250 - DNA, 1050 bp, Homo sapiens
  Payload ID: 6873
  Gene Symbol: GNPDA2
  Gene Name: glucosamine-6-phosphate deaminase 2
  Uniprot ID: Q8TDQ7
  ENST ID: ENST00000507534
  CDS Start-End: 137-757
gtgttgcttgttcccgctgttccagcatcgaagaaccattgggtctgccgggagtacacctttaggatgctataaaaaactaatagaatatcataagaatggacacctttcttttaaatatgtgaagacctttaatatggatgaatatgtaggacttccaagaaatcatcctgaaagctaccattcttatatgtggaataatttttttaagcatatcgatatagatcctaataatgcacatatccttgacgggaatgctgcagatttacaagcagaatgtgatgcttttgaaaacaaaataaaagaagctggaggaatagatctttttgttggaggaattggtccagatggtcatatcgctttcaatgagcctggatccagtttagtgtcaaggacaagattaaagactctagcaatggataccatcttggcaaatgccaaatattttgatggagatttatcaaaagtgccaactatggctctaactgttggtgtggggacagtgatggatgctagagaagtaatgatccttataacaggggcacacaaggcatttgccctgtacaaagcaatagaagaaggagtcaatcacatgtggactgtttccgctttccagcagcatccccggactatttttgtatgcgatgaagatgctactttagaattaagagttaaaactgtgaaatactttaaaggtctaatgcatgtgcacaataaacttgtggatccactattcagtatgaaagatggaaactgaaggagactggagcaaaattcagcttgaatgaacagagcactttttactaagtagtagatgaattttcagctatgcaatatgacaaaacatggggaattttgaagattgtcattttttcattcgagtctctatgttaaacattccatattttgaatatttatatcttgtacttgggtttaagagaagtagctggctctcaagattgactggctatttattataaagtactgaagtcacatagccacctataaaacagcatagaaatgtctgcctgtttaaaaagtcattttaaa

SEQ ID NO: 137251 - DNA, 484 bp, Homo sapiens
  Payload ID: 6873
  Gene Symbol: GNPDA2
  Gene Name: glucosamine-6-phosphate deaminase 2
  ENST ID: ENST00000609092
  CDS Start-End: 1-353
atggagatttatcaaaagtgccaactatggctctaactgttggtgtggggacagtgatggatgctagagaagtaatgatccttataacaggggcacacaaggcatttgccctgtacaaagcaatagaagaaggagtcaatcacatgtggactgtttccgctttccagcagcatccccggactatttttgtatgcgatgaagatgctactttagaattaagagttaaaactgtgaaatactttaaagaaatggccctcagctaccacaagttaattcaggagaactaccttctcaattctgtgcaaggctgtgcttcgaaggcaagaaagaagtttgctacagtttgggcttgaattccctgaaaatatcaagatacaagatactgagatgaccattctattatatatcacaaaacttgtaatttaagaccattctatacatcttcatcaagagattttgcgttatgctaataataaaattaaac

SEQ ID NO: 137252 - DNA, 570 bp, Homo sapiens
  Payload ID: 6873
  Gene Symbol: GNPDA2
  Gene Name: glucosamine-6-phosphate deaminase 2
  ENST ID: ENST00000608855
  CDS Start-End: 1-192
gcaatagaagaaggagtcaatcacatgtggactgtttccgctttccagcagcatccccggactatttttgtatgcgatgaagatgctactttagaattaagagttaaaactgtgaaatactttaaagaaatggccctcagctaccacaagttaattcaggagaactaccttctcaattctgtgcaagggtgagtttcagttgcacttctgttatatacaattcaaagagataaatcccaccaatatatttaataaatagctggtgatccctcatataatgaatagtacaactgacatttaaacattaattgtacttttagaaagtgaaatagcaacactgttgtctcattgtaattaccttatttataactggaattaccgatagctgtgcttcgaaggcaagaaagaagtttgctacagtttgggcttgaattccctgaaaatatcaagatacaagatactgagatgaccattctattatatatcacaaaacttgtaatttaagaccattctatacatcttcatcaagagattttgcgttatgctaataataaaattaaacaaaatgcc

SEQ ID NO: 137253 - DNA, 3860 bp, Homo sapiens
  Payload ID: 6874
  Gene Symbol: GNPNAT1
  Gene Name: glucosamine-phosphate N-acetyltransferase 1
  Uniprot ID: Q96EK6
  ENST ID: ENST00000216410
  CDS Start-End: 189-743
gaggtggaggcgttggcgctgccacgtctgggccgcggttcccaactgtggcgcgggcggtggaggaggaggtggggctggcgctgaagccggatccggatccggtgctgtgcacactggtgggggagagtccgacgcgcctggctaggagcgccgaccgcagggcctctacggaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaagagaggaagagtagaagatgttgttgttagtgatgaatgcagaggaaagcagcttggcaaattgttattatcaacccttactttgctaagcaagaaactgaactgttacaagattacccttgaatgtctaccacaaaatgttggtttctataaaaagtttggatatactgtatctgaagaaaactacatgtgtcggaggtttctaaagtaaaaatcttgtaagaaaattgtcaaaggggctaatgctacaaggctacactcttcctagagttgaaatattttgttgctgcagccgagtgacctccataaatactggactgaaaaaacattgtaatactacaagtataatgacatttagaagattactttgggctggtgggacatgctgtgaatttagattacaaatgaatattataaaggggatgatttttaaccaaaggaatatatttttaacttgaatcttttcttgcattgtatttttctaaaagtttggcttcctttcttggtagtcaagagtatgggtaataaggagttatatgtctgctatctgtgttgctcatttaaaaaaagtatacattgaataaggctgtttatcacatgcataaaattaaatatttttgtttcaaagaaacatctcaatacacttaggggtgtattgtttcccacatattaagtcagggtggataaattagttattataactaaacatagtatagtccaacattcgttgatcccaatacaggcaaacaacctggtcaaccttttgaagtagaagaaatgaaaattacttgacaagattaaaagtaaaacaatttaaatgttttactgaaagtttatatagtatagtctatgtagataaaaagtaccacttgtcttttctgtgaattatgactattcatttgttaaaaatacctaagagcaattatagtgggacatctaaggtcctctgtaaacagtgaattagcaaacctcagcctatgtgtttctaccctgatttttttcttttcatgggtatctgaagcctctaagttttttcaaaaatggagtatcacaaaattgagtgaaacacaatacttaatgtattgtactagattgccaaattcataaaatgttaatggaagctttttgatgtgattataatggcactattctggtcattatcctattttgattttatttaattttttaaagttgaagaattaaatattttaatggttctaatcttttgcattccatgttgcattaaacctgtttatatgagtagtcttctgttagaatcacatctgtgcttttcttgagtctgctgttgaactattagattaagtcataattcataaaattttagtttaatgtgctctttgtaaaatgaaattgtaaagaaaataccagtgtttctcatcccattgactcacaccacgtcatctggattttggatttccctccatgcagccagctatagttggctttccaaaacaacagaaatccttcaccaatagagtgcactacttacctgcttatagcctatacagacgaactgatctgtccttcgtgaaacgcaacaaagctagttctgtcttttcagaagtcctacaaccttgacaaagagtagttttatcaggtaaatcctggtaattaaaaacgcatgtttttaaaaattagcctggtaaggccgggtgcagtggctcacgcctgtaatcccagcactttgggaggctgaggtgggcagatcacaaggtcaggagtttgagaccagcctgaccaaaatggtgaaaccctgtctctactaaaaaaaagaaaaattagccagacgtggtggcatgcgcctgtaatcccagctactcaggaagctgaggcgagagaatcgcttgaacccgggaggcaaaggttgcagtgagctgagatcacaccactgcactccagcctggcgacagagagagactccatctcaaaacaaaacaaaaaaaattagcctacttaaaggcacaactaaatgctttattacctttcttaccactgaacaatttgaggtaaaatcattcacaaggttggcacttcagtaaatccctttaaatagtgttcctaagatatctcttaaatcctcccataggaaatagaattacaggtaaggtacaccatacaaaaattgtgtcattgaggacaatggtgatctgtaattttagttgagtatgtttatgatttttgaagccatatggtgagtaaatgtaaatatgaaaaaagtgctacataaaacacttcttaaactttttttttttaaaaactgctccttgtggagcaggactaccccataggcagtgtacccacaatagatagccttttgttgttgttgttgttgagacaaggtctcgctgttgcccaggctagagcgcaggggcacaatcaccacacactgccgcttcaatctcctgggctcaaatgatccttccacctcagcctcccatgtggctgggactataggtgcatgccaccacacccagctaattaaaaaaattttttgtgtggagtctatgttgcccaggctggtctcttaactcctaggctcaagtgatcctcccacctcagcctcccaaagtgcttggatgacaggtgcgagccactgcacctggcccacattttttaaagagacactgtcccactccatcacccaggctggagtccagtggtgtgatcatagctcactgcatcctccagttcctgggttcaagccatccctcctgcctcagcctccccagtagctggaactacaggtgtgtgccatcacacctggctttacatttttctgtggggtcttactatattgcccaagccggtctcaaactcctgagctcaagtgatcctctgcctcagcctccagagtatctgggattacatatgtcggctaccgtgtctggccgttcacatctttggccactatttgcttgtgaaaaggtataatgaggtggtacttatcatttttactgtgtctcatgttttgtatatttttgtttcatcaactaagatgcactgtaacatctctgaaatctggatatattatcaatggtttatcatagttttgttagcaatacactgtcttttagtggtgcctaaaataatggtatagttgtgaggtgatcttagatttgatgaagcacagtatgcaggtaggcctaatgggggaagatggtaatataaaagcaagaagtattttttttttgtaatgactgaaagctgttctgtggatgacctaccctttcctttaaacacgattctctcacttccaactccaaacttgctcaactaatccttaaaaataaacttgagctggaatttg

SEQ ID NO: 137254 - DNA, 785 bp, Homo sapiens
  Payload ID: 6874
  Gene Symbol: GNPNAT1
  Gene Name: glucosamine-phosphate N-acetyltransferase 1
  ENST ID: ENST00000557604
  CDS Start-End: 295-785
gggcgggtggcgccttggcctccgcctccgctcgcctgcgcgcggccctgcgtgagggggcagaggcgaggtggaggcgttggcgctgccacgtctgggccgcggttcccaactgtggcgcgggcggtggaggaggaggtggggctggcgctgaagccggatccggatccggtgctgtgcacactggtgggggagagtccgacgcgcctggctaggagcgccgaccgcagggcctctacggttcctgtaaccagcacagtgcctgattcatgaattaaagaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaagagaggaagagtagaagatgttgttgttagtgatgaatgcagaggaaagcagcttggcaaattgttattatcaacccttactttgctaagcaagaaactgaactgttacaagattacccttgaatgtctaccacaaaatgttggttt

SEQ ID NO: 137255 - DNA, 2238 bp, Homo sapiens
  Payload ID: 6874
  Gene Symbol: GNPNAT1
  Gene Name: glucosamine-phosphate N-acetyltransferase 1
  ENST ID: ENST00000554230
  CDS Start-End: 143-484
ggatccggatccggtgctgtgcacactggtgggggagagtccgacgcgcctggctaggagcgccgaccgcagggcctctacgggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaagagaggaagagtagaagatgttgttgttagtgatgaatgcagaggaaagcagcttggcaaattgttattatcaacccttactttgctaagcaagaaactgaactgttacaagattacccttgaatgtctaccacaaaatgttggtttctataaaaagtttggatatactgtatctgaagaaaactacatgtgtcggaggtttctaaagtaaaaatcttgtaagaaaattgtcaaaggggctaatgctacaaggctacactcttcctagagttgaaatattttgttgctgcagccgagtgacctccataaatactggactgaaaaaacattgtaatactacaagtataatgacatttagaagattactttgggctggtgggacatgctgtgaatttagattacaaatgaatattataaaggggatgatttttaaccaaaggaatatatttttaacttgaatcttttcttgcattgtatttttctaaaagtttggcttcctttcttggtagtcaagagtatgggtaataaggagttatatgtctgctatctgtgttgctcatttaaaaaaagtatacattgaataaggctgtttatcacatgcataaaattaaatatttttgtttcaaagaaacatctcaatacacttaggggtgtattgtttcccacatattaagtcagggtggataaattagttattataactaaacatagtatagtccaacattcgttgatcccaatacaggcaaacaacctggtcaaccttttgaagtagaagaaatgaaaattacttgacaagattaaaagtaaaacaatttaaatgttttactgaaagtttatatagtatagtctatgtagataaaaagtaccacttgtcttttctgtgaattatgactattcatttgttaaaaatacctaagagcaattatagtgggacatctaaggtcctctgtaaacagtgaattagcaaacctcagcctatgtgtttctaccctgatttttttcttttcatgggtatctgaagcctctaagttttttcaaaaatggagtatcacaaaattgagtgaaacacaatacttaatgtattgtactagattgccaaattcataaaatgttaatggaagctttttgatgtgattataatggcactattctggtcattatcctattttgattttatttaattttttaaagttgaagaattaaatattttaatggttctaatcttttgcattccatgttgcattaaacctgtttatatgagtagtcttctgttagaatcacatctgtgcttttcttgagtctgctgttgaactattagattaagtcataattcataaaattttagtttaatgtgctctttgtaaaatgaaattgtaaagaaaataccagtgtttctcatcccattgactcacaccacgtcatctggattttggatttccctccatgcagccagctatagttggctttccaaaacaacagaaatccttcaccaatagagtgcactacttacctgcttatagcctatacagacgaactgatctgtccttcgtgaaacgcaacaaagctagttctgtcttttcagaagtcctacaaccttgacaaagagtagttttatcaggtaaatcctggtaattaaaaacgcatgtttttaaaaattagcctggtaaggccgggtgcagtggctcacgcctgtaatcccagcactttgggaggctgaggtgggcagatcacaaggtcaggagtttgagaccagcctgaccaaaatggtgaaaccctgtctctactaaaaaaaagaaaaattagccagacgtggtggcatgcgcctgtaatcccagctactcaggaagctgaggcgagagaatcgcttgaacccgggaggcaaaggttgcagtgagctgagatcacaccactgcactccagcctggcgacagagagagactccatctcaaaacaaaacaaaaaaaa

SEQ ID NO: 137256 - DNA, 5518 bp, Homo sapiens
  Payload ID: 6875
  Gene Symbol: GCNT1
  Gene Name: glucosaminyl (N-acetyl) transferase 1, core 2
  Uniprot ID: Q02742
  ENST ID: ENST00000376730
  CDS Start-End: 484-1770
gcgcggggcgggagcttggtggagcaggagcggctgggcatcctcctgagactccggggtcagacgcccactccagcgctttctgcgcagcacaggcaccctcgcctgtcacgcctccctctcctcttcccgtctcccagcgtggatgagggcgcctgcagatcccggctagggcacggaccgcctaggccgagatttctttaaagactcgtgcagcacatcattatcgctggatgcccggacatgtaatacacctgacagcatgtgaagtgctcagaatggggcaggatgtcacctggaatcagcactaagtgattcagactttccttacttttaaatgtgctgctcttcatttcaagatgccgttgcagctctgataaatgcaaactgacaaccttcaaggccacgacggagggaaaatcattggtgcttggagcatagaagactgcccttcacaaaggaaatccctgattattgtttgaaatgctgaggacgttgctgcgaaggagacttttttcttatcccaccaaatactactttatggttcttgttttatccctaatcaccttctccgttttaaggattcatcaaaagcctgaatttgtaagtgtcagacacttggagcttgctggggagaatcctagtagtgatattaattgcaccaaagttttacagggtgatgtaaatgaaatccaaaaggtaaagcttgagatcctaacagtgaaatttaaaaagcgccctcggtggacacctgacgactatataaacatgaccagtgactgttcttctttcatcaagagacgcaaatatattgtagaaccccttagtaaagaagaggcggagtttccaatagcatattctatagtggttcatcacaagattgaaatgcttgacaggctgctgagggccatctatatgcctcagaatttctattgcattcatgtggacacaaaatccgaggattcctatttagctgcagtgatgggcatcgcttcctgttttagtaatgtctttgtggccagccgattggagagtgtggtttatgcatcgtggagccgggttcaggctgacctcaactgcatgaaggatctctatgcaatgagtgcaaactggaagtacttgataaatctttgtggtatggattttcccattaaaaccaacctagaaattgtcaggaagctcaagttgttaatgggagaaaacaacctggaaacggagaggatgccatcccataaagaagaaaggtggaagaagcggtatgaggtcgttaatggaaagctgacaaacacagggactgtcaaaatgcttcctccactcgaaacacctctcttttctggcagtgcctacttcgtggtcagtagggagtatgtggggtatgtactacagaatgaaaaaatccaaaagttgatggagtgggcacaagacacatacagccctgatgagtatctctgggccaccatccaaaggattcctgaagtcccgggctcactccctgccagccataagtatgatctgtctgacatgcaagcagttgccaggtttgtcaagtggcagtactttgagggtgatgtttccaagggtgctccctacccgccctgcgatggagtccatgtgcgctcagtgtgcattttcggagctggtgacttgaactggatgctgcgcaaacaccacttgtttgccaataagtttgacgtggatgttgacctctttgccatccagtgtttggatgagcatttgagacacaaagctttggagacattaaaacactgaccattacgggcaattttatgaacaagaagaaggatacacaaaacgtacccttatctgtttccccttccttgtcagcatcgggaagatggtatgaagtcctctttggggcagggactctagtagatcttcttgtcagagaagctgcatggtttctgcagagcacagttagctagaaaggtgatagcattaaatgttcatctagagttaatagtgggaggagtaaaggtagccttgaggccagagcaggtagcaaggcattgtggaaagaggggaccagggtggctggggaagaggccgatgcataaagtcagcctgttcaaagtgctcagggacttagcaaaatgagaagatgtgacctgtgccaaaactattttgagaattttaaatgtgaccatttttctggtatgaataaacttacagcaacaaataatcaaagatacaattaatctgatattatatttgttgaaatagaaatttgattgtactataaatgatttttgtaaataatttatattctgctctaatactgtactgtgtagtgtgtctccgtatgtcatctcagggagcttaaaatgggcttgatttaacattgtttttgtgttatttttgcttgaaacaacgcacacattttcaacaaccaaaaaatgacaatttctagtttagttaatttctacaaatcatcttatgttattagcaaggttaagacatcttttttaaaaaaattatagcttctaccaagagaaacactcaatttttctagagatttgcctctatcttcctttcctcagtcttcccagactgctatcaagctgtgtaaaaatttactttcactggaccctaaattattgtctctgctatctgactgccagtaattagtgcagaaaactaagacaggatgatacaggtttgaggggctggggagtgggaggggggagaaaaggaatgtatttaaacaatttccgatgcccatgatgagtttaaaaaccagcattgacaccatccccaaaattaaggctgtcgcttattgaatccacttgtgtccaacctcccaggattgttttatcctaatgtcacctgtatattcatttgaaaggacttggccctgttcttgggtcttcccgttacctgccccctgggtggtaagtttcctcctttctcaaccttccacgaggaggaaagaagtgtgcagtcattccacatggcctgttggaaggcctggggagggaactttgggtttgggacagatttttttttttgtttttggtatcattcacagcatacgatttttactctctccatcttcaccataagacagataatttggggttgctataatgctgtcacacatctcaaagtacattcaaatcttaaaaagaaattctcgtacttttgccatgttgatactgttcagcaaacaagctaccaggaactgtgaggctttgtcatttagcattagactttaaacaagaattaaaatcatgtgctgtatttttaaaatctagccaaattaaatagtacatgagaaattcagagtattagacagttttaaggcattcaactgagaaaactttatttgtcaaagtcagaaaacattttcatcttattgagagatatgtttttaaacttttatcatcatttgtaaatgtggaagttggtggattgctgtgtttttgcatgattagcatgggagtctgttggagcaagaggaacatgcttgttttgaaaactcgagatgatgagggtggtacatgcagtgtgttctctctttattggcttctaaaccagttttgtcctttaatgcatgtcaaatatttctcccatgcttctcttagcagaaaagtttttacctataagacagggcaccttttaactctaaaactagtgatactcagtgacatagactttgtcttataaacattttttcattttttattttgaaaaattgcaaatctacagcaaaagtaaaacagtagagtgaacaccatgtaaccctcacctggtgttaacattgtaccctatttgctttaagttgtatgtatttctgaacttggcaaaattggaaattaaaatttttaaaaattacaaatatacaaagttatttatcttagcacatttattatgtgtgactgcatctgatttatatttaaattggcaggttttgagggatttttttcttcatcataaatgtaaacataggattttagagtctatttccccaagcgccacattataactgtaaacttaccatcttctatgtagctgtgatatctcatctttctaaaatggaacttgttaaaaagtgttcaaacactatccctaatgcctgcggcagaatttatatacgatccattcattggggctcaaagtatcttttagacttttaaggacaatttacagcaaatgaaatttatgatgctgtgacaagaaatttaaagaatcaaaacgatggtttgaaaaggaaacctatgatacatgcaggagaagcaaaacccaagtgattggtgagaaatatagaaattatttaaattactttatagtaattattaaacactaatttttgtactgtcattgaaggtgttttatagagaaatctgagaaatcacattcacaaattagaagtcaaacatggccaggcacagtggctcacacctgtaatcttcaggatttcaagaccagcctagccaacatgacgaaaccccatctctactgaaaatagaaaaaaaaaattagccaggcttgcacctgtaatcccagttacctgggaggctgaggcaggagaatctcttgagcccaggaggcggaggttgcagtgagctgagatgccaccaccacaccagcctgggtgacagagtgaaactcgtatctccaaacaaacaaacaaaaagtccttaaacatatgtgaacaaaaattttgtgatggaaggattctagttaatgagtattgcatcaagatttacatctttcttactaaggaaaagagttaataaaaattgttctttattttacaggcagttactgaggctcttcccagatctcagtaaacagccactcagccttgaaaatggagtgttgttgtttctaaacatatatttatgtcatttattaagtacagttcacttaaataacataagtagattttctcttgtagtgatttgggtaggaagaggccatgtttcagttcgttttctctgtagggtcgattgaattggaccttttcagttgttcagaaaaataaaaataatttctcatattaaatacagacgctcctcaacttatgatgtgggtaggtcccagtaaacccattataatttgaaaatatcacattgaaaatgcatttaatatctcttacctgaaatcataacttagccaagcctaccttaaatgttctcagaacatttagcctgcagttgggcaaaaccatttaacacaaagcctattttataatgaagtgttgaatagctcatgttatttactgaatactgttgtgaaagtgaaaaacaatgattgtatgggtactcaaagtataatttctactgaatgcatatcacttgtgcactgttgtaaagctgaaaaaccgttaagcctctacgatttttaagtaagttggggaccatcagtttaaaataaatgcaatactatttcatgataaacatggtcactgtaagttttactcttttgaatgagggtgcgacagaatgcagttagaatcagttcatatcaccattaaaatcatccattcagaaaccaa

SEQ ID NO: 137257 - DNA, 5476 bp, Homo sapiens
  Payload ID: 6875
  Gene Symbol: GCNT1
  Gene Name: glucosaminyl (N-acetyl) transferase 1, core 2
  Uniprot ID: Q02742
  ENST ID: ENST00000444201
  CDS Start-End: 444-1730
gggcctctgggggcggccccggggcgggccacgctggtgtgagggctgcaggcgcagctccggagcgcctagagcgcggcgcggggcgggagcttggtggagcaggagcggctgggcatcctcctgagactccggggtcagacgcccactccagatttctttaaagactcgtgcagcacatcattatcgctggatgcccggacatgtaatacacctgacagcatgtgaagtgctcagaatggggcaggatgtcacctggaatcagcactaagtgattcagactttccttacttttaaatgtgctgctcttcatttcaagatgccgttgcagctctgataaatgcaaactgacaaccttcaaggccacgacggagggaaaatcattggtgcttggagcatagaagactgcccttcacaaaggaaatccctgattattgtttgaaatgctgaggacgttgctgcgaaggagacttttttcttatcccaccaaatactactttatggttcttgttttatccctaatcaccttctccgttttaaggattcatcaaaagcctgaatttgtaagtgtcagacacttggagcttgctggggagaatcctagtagtgatattaattgcaccaaagttttacagggtgatgtaaatgaaatccaaaaggtaaagcttgagatcctaacagtgaaatttaaaaagcgccctcggtggacacctgacgactatataaacatgaccagtgactgttcttctttcatcaagagacgcaaatatattgtagaaccccttagtaaagaagaggcggagtttccaatagcatattctatagtggttcatcacaagattgaaatgcttgacaggctgctgagggccatctatatgcctcagaatttctattgcattcatgtggacacaaaatccgaggattcctatttagctgcagtgatgggcatcgcttcctgttttagtaatgtctttgtggccagccgattggagagtgtggtttatgcatcgtggagccgggttcaggctgacctcaactgcatgaaggatctctatgcaatgagtgcaaactggaagtacttgataaatctttgtggtatggattttcccattaaaaccaacctagaaattgtcaggaagctcaagttgttaatgggagaaaacaacctggaaacggagaggatgccatcccataaagaagaaaggtggaagaagcggtatgaggtcgttaatggaaagctgacaaacacagggactgtcaaaatgcttcctccactcgaaacacctctcttttctggcagtgcctacttcgtggtcagtagggagtatgtggggtatgtactacagaatgaaaaaatccaaaagttgatggagtgggcacaagacacatacagccctgatgagtatctctgggccaccatccaaaggattcctgaagtcccgggctcactccctgccagccataagtatgatctgtctgacatgcaagcagttgccaggtttgtcaagtggcagtactttgagggtgatgtttccaagggtgctccctacccgccctgcgatggagtccatgtgcgctcagtgtgcattttcggagctggtgacttgaactggatgctgcgcaaacaccacttgtttgccaataagtttgacgtggatgttgacctctttgccatccagtgtttggatgagcatttgagacacaaagctttggagacattaaaacactgaccattacgggcaattttatgaacaagaagaaggatacacaaaacgtacccttatctgtttccccttccttgtcagcatcgggaagatggtatgaagtcctctttggggcagggactctagtagatcttcttgtcagagaagctgcatggtttctgcagagcacagttagctagaaaggtgatagcattaaatgttcatctagagttaatagtgggaggagtaaaggtagccttgaggccagagcaggtagcaaggcattgtggaaagaggggaccagggtggctggggaagaggccgatgcataaagtcagcctgttcaaagtgctcagggacttagcaaaatgagaagatgtgacctgtgccaaaactattttgagaattttaaatgtgaccatttttctggtatgaataaacttacagcaacaaataatcaaagatacaattaatctgatattatatttgttgaaatagaaatttgattgtactataaatgatttttgtaaataatttatattctgctctaatactgtactgtgtagtgtgtctccgtatgtcatctcagggagcttaaaatgggcttgatttaacattgtttttgtgttatttttgcttgaaacaacgcacacattttcaacaaccaaaaaatgacaatttctagtttagttaatttctacaaatcatcttatgttattagcaaggttaagacatcttttttaaaaaaattatagcttctaccaagagaaacactcaatttttctagagatttgcctctatcttcctttcctcagtcttcccagactgctatcaagctgtgtaaaaatttactttcactggaccctaaattattgtctctgctatctgactgccagtaattagtgcagaaaactaagacaggatgatacaggtttgaggggctggggagtgggaggggggagaaaaggaatgtatttaaacaatttccgatgcccatgatgagtttaaaaaccagcattgacaccatccccaaaattaaggctgtcgcttattgaatccacttgtgtccaacctcccaggattgttttatcctaatgtcacctgtatattcatttgaaaggacttggccctgttcttgggtcttcccgttacctgccccctgggtggtaagtttcctcctttctcaaccttccacgaggaggaaagaagtgtgcagtcattccacatggcctgttggaaggcctggggagggaactttgggtttgggacagatttttttttttgtttttggtatcattcacagcatacgatttttactctctccatcttcaccataagacagataatttggggttgctataatgctgtcacacatctcaaagtacattcaaatcttaaaaagaaattctcgtacttttgccatgttgatactgttcagcaaacaagctaccaggaactgtgaggctttgtcatttagcattagactttaaacaagaattaaaatcatgtgctgtatttttaaaatctagccaaattaaatagtacatgagaaattcagagtattagacagttttaaggcattcaactgagaaaactttatttgtcaaagtcagaaaacattttcatcttattgagagatatgtttttaaacttttatcatcatttgtaaatgtggaagttggtggattgctgtgtttttgcatgattagcatgggagtctgttggagcaagaggaacatgcttgttttgaaaactcgagatgatgagggtggtacatgcagtgtgttctctctttattggcttctaaaccagttttgtcctttaatgcatgtcaaatatttctcccatgcttctcttagcagaaaagtttttacctataagacagggcaccttttaactctaaaactagtgatactcagtgacatagactttgtcttataaacattttttcattttttattttgaaaaattgcaaatctacagcaaaagtaaaacagtagagtgaacaccatgtaaccctcacctggtgttaacattgtaccctatttgctttaagttgtatgtatttctgaacttggcaaaattggaaattaaaatttttaaaaattacaaatatacaaagttatttatcttagcacatttattatgtgtgactgcatctgatttatatttaaattggcaggttttgagggatttttttcttcatcataaatgtaaacataggattttagagtctatttccccaagcgccacattataactgtaaacttaccatcttctatgtagctgtgatatctcatctttctaaaatggaacttgttaaaaagtgttcaaacactatccctaatgcctgcggcagaatttatatacgatccattcattggggctcaaagtatcttttagacttttaaggacaatttacagcaaatgaaatttatgatgctgtgacaagaaatttaaagaatcaaaacgatggtttgaaaaggaaacctatgatacatgcaggagaagcaaaacccaagtgattggtgagaaatatagaaattatttaaattactttatagtaattattaaacactaatttttgtactgtcattgaaggtgttttatagagaaatctgagaaatcacattcacaaattagaagtcaaacatggccaggcacagtggctcacacctgtaatcttcaggatttcaagaccagcctagccaacatgacgaaaccccatctctactgaaaatagaaaaaaaaaattagccaggcttgcacctgtaatcccagttacctgggaggctgaggcaggagaatctcttgagcccaggaggcggaggttgcagtgagctgagatgccaccaccacaccagcctgggtgacagagtgaaactcgtatctccaaacaaacaaacaaaaagtccttaaacatatgtgaacaaaaattttgtgatggaaggattctagttaatgagtattgcatcaagatttacatctttcttactaaggaaaagagttaataaaaattgttctttattttacaggcagttactgaggctcttcccagatctcagtaaacagccactcagccttgaaaatggagtgttgttgtttctaaacatatatttatgtcatttattaagtacagttcacttaaataacataagtagattttctcttgtagtgatttgggtaggaagaggccatgtttcagttcgttttctctgtagggtcgattgaattggaccttttcagttgttcagaaaaataaaaataatttctcatattaaatacagacgctcctcaacttatgatgtgggtaggtcccagtaaacccattataatttgaaaatatcacattgaaaatgcatttaatatctcttacctgaaatcataacttagccaagcctaccttaaatgttctcagaacatttagcctgcagttgggcaaaaccatttaacacaaagcctattttataatgaagtgttgaatagctcatgttatttactgaatactgttgtgaaagtgaaaaacaatgattgtatgggtactcaaagtataatttctactgaatgcatatcacttgtgcactgttgtaaagctgaaaaaccgttaagcctctacgatttttaagtaagttggggaccatcagtttaaaataaatgcaatactatttcatgataaacatggtcactgtaagttttactcttttgaatgagggtgcgacagaatgcagttagaatcagttcatatcaccattaaaatcatccattcagaaacc

SEQ ID NO: 137258 - DNA, 5972 bp, Homo sapiens
  Payload ID: 6875
  Gene Symbol: GCNT1
  Gene Name: glucosaminyl (N-acetyl) transferase 1, core 2
  Uniprot ID: Q02742
  ENST ID: ENST00000442371
  CDS Start-End: 940-2226
acagaccataggtgaactgttaaggagggagaagccgcagtgtcaccttccacagtcctgctcccattaagacctatgaagtggaaaatgcagattattctttgaggtttcctgggaccagaaaaggtcagagactcttaatgggtaatgcagacaactggaatgcaatcatcaggtattcatttctgttttaaggttttatgtctgagaaacctgaaacctgaagaagtaaagcaatcatgattttttaaaaacttaataatatggttttggatttaaaaagaaagactgactcagagctggggaaaacactcacttgtgatacggatcaatgtgaaaacagcttaactctgttccatggcaattcgcacagtgtgactcagagacacctctcttcaccagctctggctcaggggatgtgaagccagaagcagaggtcacagtgacttcatctgagaaggacttaactgaccattgctggttttgaagccggaggaaggcccacagtcaatgaatgagagaggcttcgagaagctagaaatggcaaggaaatagattttcctctaaagctcccagaaagaaacacggttctgctgacacctcgattttaggccagtgagacctgcttcagacttctgacctacagaacgatttctttaaagactcgtgcagcacatcattatcgctggatgcccggacatgtaatacacctgacagcatgtgaagtgctcagaatggggcaggatgtcacctggaatcagcactaagtgattcagactttccttacttttaaatgtgctgctcttcatttcaagatgccgttgcagctctgataaatgcaaactgacaaccttcaaggccacgacggagggaaaatcattggtgcttggagcatagaagactgcccttcacaaaggaaatccctgattattgtttgaaatgctgaggacgttgctgcgaaggagacttttttcttatcccaccaaatactactttatggttcttgttttatccctaatcaccttctccgttttaaggattcatcaaaagcctgaatttgtaagtgtcagacacttggagcttgctggggagaatcctagtagtgatattaattgcaccaaagttttacagggtgatgtaaatgaaatccaaaaggtaaagcttgagatcctaacagtgaaatttaaaaagcgccctcggtggacacctgacgactatataaacatgaccagtgactgttcttctttcatcaagagacgcaaatatattgtagaaccccttagtaaagaagaggcggagtttccaatagcatattctatagtggttcatcacaagattgaaatgcttgacaggctgctgagggccatctatatgcctcagaatttctattgcattcatgtggacacaaaatccgaggattcctatttagctgcagtgatgggcatcgcttcctgttttagtaatgtctttgtggccagccgattggagagtgtggtttatgcatcgtggagccgggttcaggctgacctcaactgcatgaaggatctctatgcaatgagtgcaaactggaagtacttgataaatctttgtggtatggattttcccattaaaaccaacctagaaattgtcaggaagctcaagttgttaatgggagaaaacaacctggaaacggagaggatgccatcccataaagaagaaaggtggaagaagcggtatgaggtcgttaatggaaagctgacaaacacagggactgtcaaaatgcttcctccactcgaaacacctctcttttctggcagtgcctacttcgtggtcagtagggagtatgtggggtatgtactacagaatgaaaaaatccaaaagttgatggagtgggcacaagacacatacagccctgatgagtatctctgggccaccatccaaaggattcctgaagtcccgggctcactccctgccagccataagtatgatctgtctgacatgcaagcagttgccaggtttgtcaagtggcagtactttgagggtgatgtttccaagggtgctccctacccgccctgcgatggagtccatgtgcgctcagtgtgcattttcggagctggtgacttgaactggatgctgcgcaaacaccacttgtttgccaataagtttgacgtggatgttgacctctttgccatccagtgtttggatgagcatttgagacacaaagctttggagacattaaaacactgaccattacgggcaattttatgaacaagaagaaggatacacaaaacgtacccttatctgtttccccttccttgtcagcatcgggaagatggtatgaagtcctctttggggcagggactctagtagatcttcttgtcagagaagctgcatggtttctgcagagcacagttagctagaaaggtgatagcattaaatgttcatctagagttaatagtgggaggagtaaaggtagccttgaggccagagcaggtagcaaggcattgtggaaagaggggaccagggtggctggggaagaggccgatgcataaagtcagcctgttcaaagtgctcagggacttagcaaaatgagaagatgtgacctgtgccaaaactattttgagaattttaaatgtgaccatttttctggtatgaataaacttacagcaacaaataatcaaagatacaattaatctgatattatatttgttgaaatagaaatttgattgtactataaatgatttttgtaaataatttatattctgctctaatactgtactgtgtagtgtgtctccgtatgtcatctcagggagcttaaaatgggcttgatttaacattgtttttgtgttatttttgcttgaaacaacgcacacattttcaacaaccaaaaaatgacaatttctagtttagttaatttctacaaatcatcttatgttattagcaaggttaagacatcttttttaaaaaaattatagcttctaccaagagaaacactcaatttttctagagatttgcctctatcttcctttcctcagtcttcccagactgctatcaagctgtgtaaaaatttactttcactggaccctaaattattgtctctgctatctgactgccagtaattagtgcagaaaactaagacaggatgatacaggtttgaggggctggggagtgggaggggggagaaaaggaatgtatttaaacaatttccgatgcccatgatgagtttaaaaaccagcattgacaccatccccaaaattaaggctgtcgcttattgaatccacttgtgtccaacctcccaggattgttttatcctaatgtcacctgtatattcatttgaaaggacttggccctgttcttgggtcttcccgttacctgccccctgggtggtaagtttcctcctttctcaaccttccacgaggaggaaagaagtgtgcagtcattccacatggcctgttggaaggcctggggagggaactttgggtttgggacagatttttttttttgtttttggtatcattcacagcatacgatttttactctctccatcttcaccataagacagataatttggggttgctataatgctgtcacacatctcaaagtacattcaaatcttaaaaagaaattctcgtacttttgccatgttgatactgttcagcaaacaagctaccaggaactgtgaggctttgtcatttagcattagactttaaacaagaattaaaatcatgtgctgtatttttaaaatctagccaaattaaatagtacatgagaaattcagagtattagacagttttaaggcattcaactgagaaaactttatttgtcaaagtcagaaaacattttcatcttattgagagatatgtttttaaacttttatcatcatttgtaaatgtggaagttggtggattgctgtgtttttgcatgattagcatgggagtctgttggagcaagaggaacatgcttgttttgaaaactcgagatgatgagggtggtacatgcagtgtgttctctctttattggcttctaaaccagttttgtcctttaatgcatgtcaaatatttctcccatgcttctcttagcagaaaagtttttacctataagacagggcaccttttaactctaaaactagtgatactcagtgacatagactttgtcttataaacattttttcattttttattttgaaaaattgcaaatctacagcaaaagtaaaacagtagagtgaacaccatgtaaccctcacctggtgttaacattgtaccctatttgctttaagttgtatgtatttctgaacttggcaaaattggaaattaaaatttttaaaaattacaaatatacaaagttatttatcttagcacatttattatgtgtgactgcatctgatttatatttaaattggcaggttttgagggatttttttcttcatcataaatgtaaacataggattttagagtctatttccccaagcgccacattataactgtaaacttaccatcttctatgtagctgtgatatctcatctttctaaaatggaacttgttaaaaagtgttcaaacactatccctaatgcctgcggcagaatttatatacgatccattcattggggctcaaagtatcttttagacttttaaggacaatttacagcaaatgaaatttatgatgctgtgacaagaaatttaaagaatcaaaacgatggtttgaaaaggaaacctatgatacatgcaggagaagcaaaacccaagtgattggtgagaaatatagaaattatttaaattactttatagtaattattaaacactaatttttgtactgtcattgaaggtgttttatagagaaatctgagaaatcacattcacaaattagaagtcaaacatggccaggcacagtggctcacacctgtaatcttcaggatttcaagaccagcctagccaacatgacgaaaccccatctctactgaaaatagaaaaaaaaaattagccaggcttgcacctgtaatcccagttacctgggaggctgaggcaggagaatctcttgagcccaggaggcggaggttgcagtgagctgagatgccaccaccacaccagcctgggtgacagagtgaaactcgtatctccaaacaaacaaacaaaaagtccttaaacatatgtgaacaaaaattttgtgatggaaggattctagttaatgagtattgcatcaagatttacatctttcttactaaggaaaagagttaataaaaattgttctttattttacaggcagttactgaggctcttcccagatctcagtaaacagccactcagccttgaaaatggagtgttgttgtttctaaacatatatttatgtcatttattaagtacagttcacttaaataacataagtagattttctcttgtagtgatttgggtaggaagaggccatgtttcagttcgttttctctgtagggtcgattgaattggaccttttcagttgttcagaaaaataaaaataatttctcatattaaatacagacgctcctcaacttatgatgtgggtaggtcccagtaaacccattataatttgaaaatatcacattgaaaatgcatttaatatctcttacctgaaatcataacttagccaagcctaccttaaatgttctcagaacatttagcctgcagttgggcaaaaccatttaacacaaagcctattttataatgaagtgttgaatagctcatgttatttactgaatactgttgtgaaagtgaaaaacaatgattgtatgggtactcaaagtataatttctactgaatgcatatcacttgtgcactgttgtaaagctgaaaaaccgttaagcctctacgatttttaagtaagttggggaccatcagtttaaaataaatgcaatactatttcatgataaacatggtcactgtaagttttactcttttgaatgagggtgcgacagaatgcagttagaatcagttcatatcaccattaaaatcatccattcagaaacc

SEQ ID NO: 137259 - DNA, 4214 bp, Homo sapiens
  Payload ID: 6876
  Gene Symbol: GCNT2
  Gene Name: glucosaminyl (N-acetyl) transferase 2, I-branching enzyme (I blood group)
  Uniprot ID: Q8NFS9
  ENST ID: ENST00000265012
  CDS Start-End: 245-1453
aaccctggggaactgcagaccaaagtgagagagggacgcaccgcatctccaggcacatccaaaaaggatggacgagacaccgaagcagaggatacaggaggattaaaggattcaggaaagcaagcagccctccggagaagctgtcgaaattcaagactggcaagagaagcaaattcaacctctcacaccgatcatttctcattccctgaaaagaagagattgtttccccagggaagtgaaaataatgaacttttggaggtactgcttttttgctttcactctgctcagcgtggtcatttttgtgagattttacagtagccaattgagcccgccaaaaagttatgagaagctgaacagttccagtgaaaggtattttaggaaaactgcctgtaatcacgccttagagaaaatgccagtctttttgtgggaaaatatattaccatcacctttgcgaagtgtcccttgcaaggattacctgacccagaatcactacatcacaagtcccctgtcggaagaagaggctgcattccctttggcctatgtcatggtcatccataaggactttgacacctttgaaaggctctttagggctatctatatgccccaaaatgtctactgtgttcacgtggatgagaaagccccagctgagtataaggaatctgtgaggcagttactgagttgcttccaaaatgctttcattgcttcaaagacagagtctgtggtttatgcaggcatttccagactccaggctgacctgaactgtctgaaagaccttgtcgcctctgaggttccctggaagtacgtcatcaacacctgtggacaagacttccccctgaaaaccaaccgggagatagttcagcatctgaaaggatttaaagggaaaaatatcaccccaggggtgctgcctcctgaccatgcaattaagcgaactaaatatgtccaccaagagcatacagataaaggtggcttttttgtgaaaaatactaatattttgaaaacttcacctccacatcagctgaccatctactttggcactgcctatgtggcgcttaccagagactttgtcgactttgttctacgtgaccaaagggccattgatctactacaatggtcaaaagatacctatagtcctgatgagcatttctgggtgacacttaatagggtttcaggtgttcctggctctatgccaaatgcatcctggactggaaacctcagagctataaagtggagtgacatggaagacagacacggaggctgccacggccactatgtacatggtatttgtatctatggaaacggagacttaaagtggctggttaattcaccaagcctgtttgctaacaagtttgagcttaatacctacccccttactgtggaatgcctagaactgaggcatcgcgaaagaaccctcaatcagagtgaaactgcgatacaacccagctggtatttttgagctattcatgagctactcatgactgaagggaaactgcagctgggaagaggagcctgtttttgtgagagacttttgccttcgtaatgttaaccgtttcaggaccacgtttatagcttcaggacctggctacgtaattatacttaaaatatccactggacactgtgaaatacactaacaggatggctgggtagagcaatctgggcactttggccaattttagtcttgctgtttcttgatgctcacctctatattagtttattgttaggatcaatgataaatttaaatgacctcagatctttgcaccagatactcatcatatacaaatgttttagtaaaaaagagaattgtagataatactgtctaggaaaataagaattaggtttctttgaagaaggaatcttttataacaccttaacagtcaccactgtgctcaaccagacagatagtgaaacagctttctgggtaattcaccaatttcctttaaaacataagctacctgaatggagaatacatcttgtttctgagtttcaacactagcatttttggcttactcatggacaaagttctgtatatagtataaagtcattaacaagaaacaggatatgctttaagacagaattcactgtctgttgcttcagtaaaaggacctcggggaataaaacatttctctcttatatgccagaatgtaggctggtccctatgtcatgtcttccattaagaacactaaaaagtccttgcaagaatggagatatgcattcaagagaggtgctatcacatagatctagtctgaagtctggaacactttcctcttctatgacccctctctccccagtattatcttacttgcaaaatggagaccaaattctatcctgtgaggcttttaattgcaccatagtatgctctgagtagctttacactgcctggtactgatagtagtggctcgatttttaagagccttcaattgtagatgaacatctctgttatttatccctcattcatccatccgttcattcattcagccttcaatcaacatctcttgagtgtctattatgtacaggacatgtactgagacaaaaaggaaacataagagctttttcactctaaaaatcttggcaataatgtcaacaccagaaagcctcctctggagaatcttacagagtgattgtagtttaatacaggaacacacagggctgtgtagcatgataccaggcccaggagatcagtaattacaaattaagggttaaatcagagattattcaacagagagggagaaaggaggagacagagggaggacctgttgtgttccagccattctggtattcctttatgtatctaatttcattcaaacctcacaacagtcttgtgaggcccttatataattactcccattttgcagatgaagtaactgaggcttagaaaggttaatagcaccggggaacaatttctctgggtgagaattgggactctgttgctggtcttctcagttcatttcctgaggtggatttactgagagaaggtgaaataaagccatatttagtataccagagaaggtagattttaagaatggtctcagtgttaatactgagaaaaagtcctgtcagttcagaaaaaatgtgaagtctactttagtattcctgtaatactaaaccgttgagtttctaaatatttatttattctaacaaaaagcaattactacaaatggatgacacatttaatgaacacaattttattttttttctgtaactgtgcttgttgaatgtcaatcatatttaaagggaatgactttgaagtaaaaccttttttcttgctactgaaaaaaatggagttgttttgggtggtaaagtgttaaggaatagggacagctggtcacacaaggaactcttgaaggccacatgtgaaaacctgtcacttgcacagaggccagtcccactaaggtgaccagagtgggctccaagcacaaactgccattggctatagatgggactgtgtccccccaaaattcatgtgttggagccttaaccctcaatgtgatggtatttgagatggggcctttggtaagggaagtttagatgaggtcacgagggtaggaccctcatgatgggatgagtccccttacaagacctctggcttgggccgggcgtggtggctcacacctgtaatcccaacactttgggaggccaaggcaggtagatcacttgatgccaggagttccagaccaggctggccgacatggtgaaaccccatctctactaaaaaatataaaaattagccgggctttgtggcatgtgcctgtaatcccagctatttggcaggctgaggcatgagaatcgcttgaacccaggaggtggaggttacagtgagctgagagtgccccactgcactccagcctgggtgacagagcgagactttgtcccaaaacaaaataggtgaggggatagcgaatgcactcagggtcagcagtggagtttaaaaattgtctcttttcaacttatttaaatgacagcacctgagaagaggaaccgttttacactggatgtttctcatgtagaacaagaaatctttctggaattgatgtttacatgtctgttgttggtcatctctcctgtgtcttaaatactttaatgttggaagagcatagtgtttgggctagtgggtttctgacagcccatgggaatgccctgaaactactgtatctgatgtttgttttcgatgaggttccatgttttgttttcttgggaataaattaatatattgttttcca

SEQ ID NO: 137260 - DNA, 4381 bp, Homo sapiens
  Payload ID: 6876
  Gene Symbol: GCNT2
  Gene Name: glucosaminyl (N-acetyl) transferase 2, I-branching enzyme (I blood group)
  Uniprot ID: Q06430
  ENST ID: ENST00000316170
  CDS Start-End: 418-1620
actgcgctcattccctgaatggcagtaaccagggggcgggggtggcatgggaaatgaaagaaagagatatgggaaactaaatctgccgggggaaagagagttaccggagttttagcaaaacagctagcagatgcaaacggggaggcagagggaggagggaaggctgggcttcagcaacctgccacggggatttaaacaaaggaggtttgagagaggcgggatctggctgtaatatcggcacagggacagagacagcagctggactctcgggatgaaacggaatcgattcccagcgtctccaacagggcaggagtgagtggagtatgttgcaaaataagaactcagagaaacgagtgagtttggaaaaaagacttacagattttgacggtctcttgacatttcacccttctttgaggcatgcctttatcaatgcgttacctcttcataatttctgtctctagtgtaattatttttatcgtcttctctgtgttcaattttgggggagatccaagcttccaaaggctaaatatctcagaccctttgaggctgactcaagtttgcacatcttttatcaatggaaaaacacgtttcctgtggaaaaacaaactaatgatccatgagaagtcttcttgcaaggaatacttgacccagagccactacatcacagcccctttatctaaggaagaagctgactttcccttggcatatataatggtcatccatcatcactttgacacctttgcaaggctcttcagggctatttacatgccccaaaatatctactgtgttcatgtggatgaaaaagcaacaactgaatttaaagatgcggtagagcaactattaagctgcttcccaaacgcttttctggcttccaagatggaacccgttgtctatggagggatctccaggctccaggctgacctgaactgcatcagagatctttctgccttcgaggtctcatggaagtacgttatcaacacctgtgggcaagacttccccctgaaaaccaacaaggaaatagttcagtatctgaaaggatttaaaggtaaaaatatcaccccaggggtgctgcccccagctcatgcaattggacggactaaatatgtccaccaagagcacctgggcaaagagctttcctatgtgataagaacaacagcgttgaaaccgcctcccccccataatctcacaatttactttggctctgcctatgtggctctatcaagagagtttgccaactttgttctgcatgacccacgggctgttgatttgctccagtggtccaaggacactttcagtcctgatgagcatttctgggtgacactcaataggattccaggtgttcctggctctatgccaaatgcatcctggactggaaacctcagagctataaagtggagtgacatggaagacagacacggaggctgccacggccactatgtacatggtatttgtatctatggaaacggagacttaaagtggctggttaattcaccaagcctgtttgctaacaagtttgagcttaatacctacccccttactgtggaatgcctagaactgaggcatcgcgaaagaaccctcaatcagagtgaaactgcgatacaacccagctggtatttttgagctattcatgagctactcatgactgaagggaaactgcagctgggaagaggagcctgtttttgtgagagacttttgccttcgtaatgttaaccgtttcaggaccacgtttatagcttcaggacctggctacgtaattatacttaaaatatccactggacactgtgaaatacactaacaggatggctgggtagagcaatctgggcactttggccaattttagtcttgctgtttcttgatgctcacctctatattagtttattgttaggatcaatgataaatttaaatgacctcagatctttgcaccagatactcatcatatacaaatgttttagtaaaaaagagaattgtagataatactgtctaggaaaataagaattaggtttctttgaagaaggaatcttttataacaccttaacagtcaccactgtgctcaaccagacagatagtgaaacagctttctgggtaattcaccaatttcctttaaaacataagctacctgaatggagaatacatcttgtttctgagtttcaacactagcatttttggcttactcatggacaaagttctgtatatagtataaagtcattaacaagaaacaggatatgctttaagacagaattcactgtctgttgcttcagtaaaaggacctcggggaataaaacatttctctcttatatgccagaatgtaggctggtccctatgtcatgtcttccattaagaacactaaaaagtccttgcaagaatggagatatgcattcaagagaggtgctatcacatagatctagtctgaagtctggaacactttcctcttctatgacccctctctccccagtattatcttacttgcaaaatggagaccaaattctatcctgtgaggcttttaattgcaccatagtatgctctgagtagctttacactgcctggtactgatagtagtggctcgatttttaagagccttcaattgtagatgaacatctctgttatttatccctcattcatccatccgttcattcattcagccttcaatcaacatctcttgagtgtctattatgtacaggacatgtactgagacaaaaaggaaacataagagctttttcactctaaaaatcttggcaataatgtcaacaccagaaagcctcctctggagaatcttacagagtgattgtagtttaatacaggaacacacagggctgtgtagcatgataccaggcccaggagatcagtaattacaaattaagggttaaatcagagattattcaacagagagggagaaaggaggagacagagggaggacctgttgtgttccagccattctggtattcctttatgtatctaatttcattcaaacctcacaacagtcttgtgaggcccttatataattactcccattttgcagatgaagtaactgaggcttagaaaggttaatagcaccggggaacaatttctctgggtgagaattgggactctgttgctggtcttctcagttcatttcctgaggtggatttactgagagaaggtgaaataaagccatatttagtataccagagaaggtagattttaagaatggtctcagtgttaatactgagaaaaagtcctgtcagttcagaaaaaatgtgaagtctactttagtattcctgtaatactaaaccgttgagtttctaaatatttatttattctaacaaaaagcaattactacaaatggatgacacatttaatgaacacaattttattttttttctgtaactgtgcttgttgaatgtcaatcatatttaaagggaatgactttgaagtaaaaccttttttcttgctactgaaaaaaatggagttgttttgggtggtaaagtgttaaggaatagggacagctggtcacacaaggaactcttgaaggccacatgtgaaaacctgtcacttgcacagaggccagtcccactaaggtgaccagagtgggctccaagcacaaactgccattggctatagatgggactgtgtccccccaaaattcatgtgttggagccttaaccctcaatgtgatggtatttgagatggggcctttggtaagggaagtttagatgaggtcacgagggtaggaccctcatgatgggatgagtccccttacaagacctctggcttgggccgggcgtggtggctcacacctgtaatcccaacactttgggaggccaaggcaggtagatcacttgatgccaggagttccagaccaggctggccgacatggtgaaaccccatctctactaaaaaatataaaaattagccgggctttgtggcatgtgcctgtaatcccagctatttggcaggctgaggcatgagaatcgcttgaacccaggaggtggaggttacagtgagctgagagtgccccactgcactccagcctgggtgacagagcgagactttgtcccaaaacaaaataggtgaggggatagcgaatgcactcagggtcagcagtggagtttaaaaattgtctcttttcaacttatttaaatgacagcacctgagaagaggaaccgttttacactggatgtttctcatgtagaacaagaaatctttctggaattgatgtttacatgtctgttgttggtcatctctcctgtgtcttaaatactttaatgttggaagagcatagtgtttgggctagtgggtttctgacagcccatgggaatgccctgaaactactgtatctgatgtttgttttcgatgaggttccatgttttgttttcttgggaataaattaatatattgttttcca

SEQ ID NO: 137261 - DNA, 4525 bp, Homo sapiens
  Payload ID: 6876
  Gene Symbol: GCNT2
  Gene Name: glucosaminyl (N-acetyl) transferase 2, I-branching enzyme (I blood group)
  Uniprot ID: Q8N0V5
  ENST ID: ENST00000379597
  CDS Start-End: 557-1765
atatctctccaggcagtattcacatgctttaaactgaagctcgtagcttggcagtgcagtttaagcaaataaactcaggctgttgaacacaatgattaacaggaagcaggggaggggacatagttactagactctggccgggacaagaggctgaggttaaggtcttagagccgatgacttgcagaatggtcacctcacccacttgtaatttcatggtgggaacaggtggaccccctggaatcagaacctctctgaggacatctgtttttgtgtagacacaggttgcaggttagcaggagaacaggcaagccaaatgcaaaggagccacttcagaaatgtgtcacagaaaagtgaaaatgcaacctagtggtaagtgaagaggggaagaagaaagaaaaaggaccagaaccgtgaactgaagggacagggaacagccagacgagagcttcagccatcacgaggatgatttcggaacctggagaaaatgtaagttaaatatatctacactctgatcctatctcaagagagagatattttactcatttcctggttgtgaatgatgggctcttggaagcactgtctttttagcgcgtctcttatctctgccctgatttttgtatttgtttacaatactgagttatgggagaataaacgttttctgagggcagctctgtccaatgcttcactgttagcagaagcctgtcatcagatttttgaggggaaagttttttacccaacagaaaatgcattgaaaactacccttgatgaagctacctgctatgagtacatggttcgaagccactatgtaacagaaacactctctgaagaagaggctgggttccctttagcttacacagtgaccatccacaaagacttcggcacttttgagaggctcttcagggcgatttatatgccccaaaatgtctactgtgtgcacctggatcagaaggcgacggatgcctttaaaggtgcagtgaaacagttactcagctgcttcccaaatgcttttctggcttccaagaaggagtcggttgtctatggggggatctccaggctccaggctgacctgaactgcctggaagaccttgtggcctctgaagttccctggaagtatgtcatcaacacctgcgggcaagactttcccctgaaaaccaacagggaaatagttcagtatctgaagggatttaaagggaaaaatatcacccccggagtgctgcctcctgaccacgctgttggacggactaaatacgtccaccaagaactgttaaaccacaaaaattcctacgtgattaaaacaacaaaattaaaaactcctcctcctcatgacatggtgatttactttggcacggcctacgtggctctcacaagggactttgctaacttcgtcctccaagaccagctcgcacttgacttactctcctggtccaaggacacctacagccccgacgaacatttctgggtgacactcaacaggattcccggtgttcctggctctatgccaaatgcatcctggactggaaacctcagagctataaagtggagtgacatggaagacagacacggaggctgccacggccactatgtacatggtatttgtatctatggaaacggagacttaaagtggctggttaattcaccaagcctgtttgctaacaagtttgagcttaatacctacccccttactgtggaatgcctagaactgaggcatcgcgaaagaaccctcaatcagagtgaaactgcgatacaacccagctggtatttttgagctattcatgagctactcatgactgaagggaaactgcagctgggaagaggagcctgtttttgtgagagacttttgccttcgtaatgttaaccgtttcaggaccacgtttatagcttcaggacctggctacgtaattatacttaaaatatccactggacactgtgaaatacactaacaggatggctgggtagagcaatctgggcactttggccaattttagtcttgctgtttcttgatgctcacctctatattagtttattgttaggatcaatgataaatttaaatgacctcagatctttgcaccagatactcatcatatacaaatgttttagtaaaaaagagaattgtagataatactgtctaggaaaataagaattaggtttctttgaagaaggaatcttttataacaccttaacagtcaccactgtgctcaaccagacagatagtgaaacagctttctgggtaattcaccaatttcctttaaaacataagctacctgaatggagaatacatcttgtttctgagtttcaacactagcatttttggcttactcatggacaaagttctgtatatagtataaagtcattaacaagaaacaggatatgctttaagacagaattcactgtctgttgcttcagtaaaaggacctcggggaataaaacatttctctcttatatgccagaatgtaggctggtccctatgtcatgtcttccattaagaacactaaaaagtccttgcaagaatggagatatgcattcaagagaggtgctatcacatagatctagtctgaagtctggaacactttcctcttctatgacccctctctccccagtattatcttacttgcaaaatggagaccaaattctatcctgtgaggcttttaattgcaccatagtatgctctgagtagctttacactgcctggtactgatagtagtggctcgatttttaagagccttcaattgtagatgaacatctctgttatttatccctcattcatccatccgttcattcattcagccttcaatcaacatctcttgagtgtctattatgtacaggacatgtactgagacaaaaaggaaacataagagctttttcactctaaaaatcttggcaataatgtcaacaccagaaagcctcctctggagaatcttacagagtgattgtagtttaatacaggaacacacagggctgtgtagcatgataccaggcccaggagatcagtaattacaaattaagggttaaatcagagattattcaacagagagggagaaaggaggagacagagggaggacctgttgtgttccagccattctggtattcctttatgtatctaatttcattcaaacctcacaacagtcttgtgaggcccttatataattactcccattttgcagatgaagtaactgaggcttagaaaggttaatagcaccggggaacaatttctctgggtgagaattgggactctgttgctggtcttctcagttcatttcctgaggtggatttactgagagaaggtgaaataaagccatatttagtataccagagaaggtagattttaagaatggtctcagtgttaatactgagaaaaagtcctgtcagttcagaaaaaatgtgaagtctactttagtattcctgtaatactaaaccgttgagtttctaaatatttatttattctaacaaaaagcaattactacaaatggatgacacatttaatgaacacaattttattttttttctgtaactgtgcttgttgaatgtcaatcatatttaaagggaatgactttgaagtaaaaccttttttcttgctactgaaaaaaatggagttgttttgggtggtaaagtgttaaggaatagggacagctggtcacacaaggaactcttgaaggccacatgtgaaaacctgtcacttgcacagaggccagtcccactaaggtgaccagagtgggctccaagcacaaactgccattggctatagatgggactgtgtccccccaaaattcatgtgttggagccttaaccctcaatgtgatggtatttgagatggggcctttggtaagggaagtttagatgaggtcacgagggtaggaccctcatgatgggatgagtccccttacaagacctctggcttgggccgggcgtggtggctcacacctgtaatcccaacactttgggaggccaaggcaggtagatcacttgatgccaggagttccagaccaggctggccgacatggtgaaaccccatctctactaaaaaatataaaaattagccgggctttgtggcatgtgcctgtaatcccagctatttggcaggctgaggcatgagaatcgcttgaacccaggaggtggaggttacagtgagctgagagtgccccactgcactccagcctgggtgacagagcgagactttgtcccaaaacaaaataggtgaggggatagcgaatgcactcagggtcagcagtggagtttaaaaattgtctcttttcaacttatttaaatgacagcacctgagaagaggaaccgttttacactggatgtttctcatgtagaacaagaaatctttctggaattgatgtttacatgtctgttgttggtcatctctcctgtgtcttaaatactttaatgttggaagagcatagtgtttgggctagtgggtttctgacagcccatgggaatgccctgaaactactgtatctgatgtttgttttcgatgaggttccatgttttgttttcttgggaataaattaatatattgttttcc

SEQ ID NO: 137262 - DNA, 1255 bp, Homo sapiens
  Payload ID: 6876
  Gene Symbol: GCNT2
  Gene Name: glucosaminyl (N-acetyl) transferase 2, I-branching enzyme (I blood group)
  ENST ID: ENST00000410107
  CDS Start-End: 290-640
gataactggtttacgtctgttctttgtgttgctatagacttgttgtttgggtttgtgttatctttttgatctgcaggactaatagtaaaagtctgtagcttcagttatagactaagattactactctgccagaagtagtgaataaagaatcaactgggtgggatgaatcacgtttcacttgtgctgcccaggctggagtgcagtggcactatcttggcacactgtggcttatgtcacgggttcaagcgattctgctgtctcagcctcccaagtatggattacaggacaaatggaaggaaagatttttggaagcagcttcttgtgtccgacccgctgtgatcagctgctactcccaggtgttcctggctctatgccaaatgcatcctggactggaaacctcagagctataaagtggagtgacatggaagacagacacggaggctgccacggccactatgtacatggtatttgtatctatggaaacggagacttaaagtggctggttaattcaccaagcctgtttgctaacaagtttgagcttaatacctacccccttactgtggaatgcctagaactgaggcatcgcgaaagaaccctcaatcagagtgaaactgcgatacaacccagctggtatttttgagctattcatgagctactcatgactgaagggaaactgcagctgggaagaggagcctgtttttgtgagagacttttgccttcgtaatgttaaccgtttcaggaccacgtttatagcttcaggacctggctacgtaattatacttaaaatatccactggacactgtgaaatacactaacaggatggctgggtagagcaatctgggcactttggccaattttagtcttgctgtttcttgatgctcacctctatattagtttattgttaggatcaatgataaatttaaatgacctcagatctttgcaccagatactcatcatatacaaatgttttagtaaaaaagagaattgtagataatactgtctaggaaaataagaattaggtttctttgaagaaggaatcttttataacaccttaacagtcaccactgtgctcaaccagacagatagtgaaacagctttctgggtaattcaccaatttcctttaaaacataagctacctgaatggagaatacatcttgtttctgagtttcaacactagcatttttggcttactcatggacaaagttctgtatatagtataaagtcattaacaagaaacaggatatgctttaagaca

SEQ ID NO: 137263 - DNA, 2214 bp, Homo sapiens
  Payload ID: 6876
  Gene Symbol: GCNT2
  Gene Name: glucosaminyl (N-acetyl) transferase 2, I-branching enzyme (I blood group)
  Uniprot ID: Q8N0V5
  ENST ID: ENST00000495262
  CDS Start-End: 536-1744
aaacaggcttactgtgttcactgctggacgcctctgggcaatcttaccctcctgggaactgagagagacaatgctaggagccagaaacatgaggaatacatgagctcggcgccaatggaacatgctttcacaccgggtgcagctaaccaccacatcatacaaaactcgtcgctgacgttttagatgtataatctgattggcatggactcacagaggagggagtaagggaagagtaagaagatttcaaaggagagacacaggttgcaggttagcaggagaacaggcaagccaaatgcaaaggagccacttcagaaatgtgtcacagaaaagtgaaaatgcaacctagtggtaagtgaagaggggaagaagaaagaaaaaggaccagaaccgtgaactgaagggacagggaacagccagacgagagcttcagccatcacgaggatgatttcggaacctggagaaaatgtaagttaaatatatctacactctgatcctatctcaagagagagatattttactcatttcctggttgtgaatgatgggctcttggaagcactgtctttttagcgcgtctcttatctctgccctgatttttgtatttgtttacaatactgagttatgggagaataaacgttttctgagggcagctctgtccaatgcttcactgttagcagaagcctgtcatcagatttttgaggggaaagttttttacccaacagaaaatgcattgaaaactacccttgatgaagctacctgctatgagtacatggttcgaagccactatgtaacagaaacactctctgaagaagaggctgggttccctttagcttacacagtgaccatccacaaagacttcggcacttttgagaggctcttcagggcgatttatatgccccaaaatgtctactgtgtgcacctggatcagaaggcgacggatgcctttaaaggtgcagtgaaacagttactcagctgcttcccaaatgcttttctggcttccaagaaggagtcggttgtctatggggggatctccaggctccaggctgacctgaactgcctggaagaccttgtggcctctgaagttccctggaagtatgtcatcaacacctgcgggcaagactttcccctgaaaaccaacagggaaatagttcagtatctgaagggatttaaagggaaaaatatcacccccggagtgctgcctcctgaccacgctgttggacggactaaatacgtccaccaagaactgttaaaccacaaaaattcctacgtgattaaaacaacaaaattaaaaactcctcctcctcatgacatggtgatttactttggcacggcctacgtggctctcacaagggactttgctaacttcgtcctccaagaccagctcgcacttgacttactctcctggtccaaggacacctacagccccgacgaacatttctgggtgacactcaacaggattcccggtgttcctggctctatgccaaatgcatcctggactggaaacctcagagctataaagtggagtgacatggaagacagacacggaggctgccacggccactatgtacatggtatttgtatctatggaaacggagacttaaagtggctggttaattcaccaagcctgtttgctaacaagtttgagcttaatacctacccccttactgtggaatgcctagaactgaggcatcgcgaaagaaccctcaatcagagtgaaactgcgatacaacccagctggtatttttgagctattcatgagctactcatgactgaagggaaactgcagctgggaagaggagcctgtttttgtgagagacttttgccttcgtaatgttaaccgtttcaggaccacgtttatagcttcaggacctggctacgtaattatacttaaaatatccactggacactgtgaaatacactaacaggatggctgggtagagcaatctgggcactttggccaattttagtcttgctgtttcttgatgctcacctctatattagtttattgttaggatcaatgataaatttaaatgacctcagatctttgcaccagatactcatcatatacaaatgttttagtaaaaaagagaattgtagataatactgtctaggaaaataagaattaggtttctttgaagaaggaatcttttataacaccttaacagtcaccactgtgctcaaccagacagatagtgaaacagctttctgggtaattca

SEQ ID NO: 137264 - DNA, 4933 bp, Homo sapiens
  Payload ID: 6877
  Gene Symbol: GCNT3
  Gene Name: glucosaminyl (N-acetyl) transferase 3, mucin type
  Uniprot ID: O95395
  ENST ID: ENST00000396065
  CDS Start-End: 449-1765
agtcagagcctcttctctctaagtcacgggaactgcccttgctacttgtgacctgccctttactcagcagtttttgttctgggaagccctgggattctgctaatacctatcactgtaggtgctgaagggaaacagatgaagaacatgacctcaaggagcttcctgtcaatgagaagaccaagctgacgcctggcaaagatattaaagaggagcctgaaactgttccttggacatcttatgaatgtcagaaaataccttttggagggttagaagatcaggggacatggttgttcacatttgctgccacggaacaccgccagtcttcacttggaaacagaatcacgccttgtgaagagatcatccctaagcaggagagaagctactaaaggattgtgtcctcctccaccttccctgtgctcggtctccacctgtctcccattctgtgacgatggttcaatggaagagactctgccagctgcattacttgtgggctctgggctgctatatgctgctggccactgtggctctgaaactttctttcaggttgaagtgtgactctgaccacttgggtctggagtccagggaatctcaaagccagtactgtaggaatatcttgtataatttcctgaaacttccagcaaagaggtctatcaactgttcaggggtcacccgaggggaccaagaggcagtgcttcaggctattctgaataacctggaggtcaagaagaagcgagagcctttcacagacacccactacctctccctcaccagagactgtgagcacttcaaggctgaaaggaagttcatacagttcccactgagcaaagaagaggtggagttccctattgcatactctatggtgattcatgagaagattgaaaactttgaaaggctactgcgagctgtgtatgcccctcagaacatatactgtgtccatgtggatgagaagtccccagaaactttcaaagaggcggtcaaagcaattatttcttgcttcccaaatgtcttcatagccagtaagctggttcgggtggtttatgcctcctggtccagggtgcaagctgacctcaactgcatggaagacttgctccagagctcagtgccgtggaaatacttcctgaatacatgtgggacggactttcctataaagagcaatgcagagatggtccaggctctcaagatgttgaatgggaggaatagcatggagtcagaggtacctcctaagcacaaagaaacccgctggaaatatcactttgaggtagtgagagacacattacacctaaccaacaagaagaaggatcctcccccttataatttaactatgtttacagggaatgcgtacattgtggcttcccgagatttcgtccaacatgttttgaagaaccctaaatcccaacaactgattgaatgggtaaaagacacttatagcccagatgaacacctctgggccacccttcagcgtgcacggtggatgcctggctctgttcccaaccaccccaagtacgacatctcagacatgacttctattgccaggctggtcaagtggcagggtcatgagggagacatcgataagggtgctccttatgctccctgctctggaatccaccagcgggctatctgcgtttatggggctggggacttgaattggatgcttcaaaaccatcacctgttggccaacaagtttgacccaaaggtagatgataatgctcttcagtgcttagaagaatacctacgttataaggccatctatgggactgaactttgagacacactatgagagcgttgctacctgtggggcaagagcatgtacaaacatgctcagaacttgctgggacagtgtgggtgggagaccagggctttgcaattcgtggcatcctttaggataagagggctgctattagagtgtgggtaagtagatcttttgccttgcaaattgctgcctgggtgaatgctgcttgttctctcacccctaaccctagtagttcctccactaactttctcactaagtgagaatgagaactgctgtgatagggagagtgaaggagggatatgtggtagagcacttgatttcagttgaatgcctgctggtagcttttccattctgtggagctgccgttcctaataattccaggtttggtagcgtggaggagaactttgatggaaagagaaccttcccttctgtactgttaacttaaaaataaatagctcctgattcaaagtattacctctactttttgcctagtatgccagaaataatataaatataaacagataaagtgtgtgagactttttctcataactattcatgacatttaaaatccctaggggctggcaagagagttctcattattctgaaatggtcctgacaagctgcatgaatagcaattttttttttgagacagagtcttgctctgtcacccaggctggactgcagtagtgcaatctcagttcactgcaacctccgcctcccaggttcaagcgatactcccacctcagcctcctgagtagctgggactacaggcatgcagcaccatgtctggctaatttttgtatttttagtagaggccgggtttcaccatattcgccaggctggtcttgaactcctgaccttgtgatctgcccgcctcggccttccgaaatgctgggattacaggtgggaactactgcgcctggcctacaaatagcaaattctaacgaagacaggggaacagggatggttcttccattgttaaaagccatcctcattttgtttatattgccaggtttgtgatttttctgtaaaggaaaaggcagggtgatttaaccagtttgaccacctttcctgtactcttacaggaaaatcgcagcactaattctaattttgtccactttacagccaaagcttagctaatgttccataaaggagataatagccaatcaggtaaggtaatgtgtaattcattattcaaagtggaacatgtttttgtagggggagagtctgcactattaataattgtattgagaaataaaaataaactaggactattcagttaaaccaggatgtcttattattccatgtttaggcctcttgagtcaaaactctttttttttttttttttttttttttttttggagacaggttctcactctgttgcccaggctggagtgcagtggcatgatcttggctcactgaagcctctgcctcccaggttcaagtgattctccccccaaaccttgcaagtagctgggattacagatgtgagccaccatgcccagctgatttttgtgtatttttagtaaagatggggtttcaccatgttggccaggttggtctcaaactcctggcctcaagtgatccacctgccccagcctcccaaagtgctgggattacaggtgtgagccaccatgcctggtcccctcttgagtcaaaactcttatttcagaatgcgaatggaaggatcgctattagtgattctgcagattacacatttccttgcggggagacaataaggtatgtgtaaatacatatatgtgtgtgtatgtatacacacatacagcacgctacctcccaagtgttacctagtgaaacagtttcctttccgaagctccagagatggttgttggctaagttatactcttctgtgatgggcaagggatactataaaaacataggcagtgccctttgaatatagtacagctcatcttctgcatacgatatgccctggaaaggtgatttatatgcaagttaattggtgtaatctgaaggatgctcccattaatacgtcatgatgtcattaatatgtttcttcctttctgatttttgtttttttttttttttttgagacagagtctcactctgtcacccaggttggagtgcaacgaatggcgcaatcttggctcattacaacctccgcctcctgggtccaagcgattctcctgcctcagcctcctgagtaactgggattacaggtgtgtgccaccttgcctggctaatttttttgtatttttttagtagaaacagggtttcaccatgttggtcaggctggtctgaactcctgacctcaagtgatccacttgccttggcttcccaaagtgctgggattacaggcgtgagctaccgcacccagccctttctgagtgttgtcattcaattcatcaagttttctgtcatgatcaactttctctatgcaaaccctgtaactctgacagttatcactgtgtctgacacagtgaattttttatttataaggtagttacttttggccaggtgtggtggctgacgcctgtaatcccagcactttgggaggccaaggtaggcagatcacttgaggtcaggagttcaagatcagcctggccaacatggtgaatccccatctctactaaaaatataaaaattagccagacatggtggtgggtacctgtaatcccagctacttgggaggctgaggcaggagaatcgcttgaacatgggaggcagaggttgcagtgagctgagatcgtaccactgcactccagcctgggcgatagagccagactgagtctcaaaaaaaaaaaaaaagttacctttttttggtaaggttgtacttcttagataatggtcattgtcactaccaacttgcctgcattgtaatagagtcctattcactttgctcccaaccccactacggagatgactgatgactagttgtatacacagtgggtgtgccctgagaggtctgttgccagcagtggtgatcgatcacggcctccccctgctggctgatgtgatggtccttggtcctcctctgaaggaggtagaaggggcacacggccaccgtgggaagtaggcagaaaagcctccctgggtgcagattctctgagaaaagaactttggcctcatagttaacttactccaaaagctttcatgtgaaataatttataattttttatataaataaaaagattaaaatgtgaa

SEQ ID NO: 137265 - DNA, 2360 bp, Homo sapiens
  Payload ID: 6877
  Gene Symbol: GCNT3
  Gene Name: glucosaminyl (N-acetyl) transferase 3, mucin type
  Uniprot ID: O95395
  ENST ID: ENST00000560585
  CDS Start-End: 591-1907
agtcagagcctcttctctctaagtcacgggaactgcccttgctacttgtgacctgccctttactcagcagtttttgttctgggaagccctgggattctgctaatacctatcactgtaggtgctgaagggaaacagatgaagaacatgacctcaaggagcttcctgtcaatgagaagaccaagctgacgcctggcaaagcattcttcctgcctcactgacctccctgaatgacttgggcttgagaatgtttctgcatgatttctctgagcttgctgtcttacctgagagcaggaagtcaaaaggagagtgatggagccacctgctgccctctactttgcagatattaaagaggagcctgaaactgttccttggacatcttatgaatgtcagaaaataccttttggagggttagaagatcaggggacatggttgttcacatttgctgccacggaacaccgccagtcttcacttggaaacagaatcacgccttgtgaagagatcatccctaagcaggagagaagctactaaaggattgtgtcctcctccaccttccctgtgctcggtctccacctgtctcccattctgtgacgatggttcaatggaagagactctgccagctgcattacttgtgggctctgggctgctatatgctgctggccactgtggctctgaaactttctttcaggttgaagtgtgactctgaccacttgggtctggagtccagggaatctcaaagccagtactgtaggaatatcttgtataatttcctgaaacttccagcaaagaggtctatcaactgttcaggggtcacccgaggggaccaagaggcagtgcttcaggctattctgaataacctggaggtcaagaagaagcgagagcctttcacagacacccactacctctccctcaccagagactgtgagcacttcaaggctgaaaggaagttcatacagttcccactgagcaaagaagaggtggagttccctattgcatactctatggtgattcatgagaagattgaaaactttgaaaggctactgcgagctgtgtatgcccctcagaacatatactgtgtccatgtggatgagaagtccccagaaactttcaaagaggcggtcaaagcaattatttcttgcttcccaaatgtcttcatagccagtaagctggttcgggtggtttatgcctcctggtccagggtgcaagctgacctcaactgcatggaagacttgctccagagctcagtgccgtggaaatacttcctgaatacatgtgggacggactttcctataaagagcaatgcagagatggtccaggctctcaagatgttgaatgggaggaatagcatggagtcagaggtacctcctaagcacaaagaaacccgctggaaatatcactttgaggtagtgagagacacattacacctaaccaacaagaagaaggatcctcccccttataatttaactatgtttacagggaatgcgtacattgtggcttcccgagatttcgtccaacatgttttgaagaaccctaaatcccaacaactgattgaatgggtaaaagacacttatagcccagatgaacacctctgggccacccttcagcgtgcacggtggatgcctggctctgttcccaaccaccccaagtacgacatctcagacatgacttctattgccaggctggtcaagtggcagggtcatgagggagacatcgataagggtgctccttatgctccctgctctggaatccaccagcgggctatctgcgtttatggggctggggacttgaattggatgcttcaaaaccatcacctgttggccaacaagtttgacccaaaggtagatgataatgctcttcagtgcttagaagaatacctacgttataaggccatctatgggactgaactttgagacacactatgagagcgttgctacctgtggggcaagagcatgtacaaacatgctcagaacttgctgggacagtgtgggtgggagaccagggctttgcaattcgtggcatcctttaggataagagggctgctattagagtgtgggtaagtagatcttttgccttgcaaattgctgcctgggtgaatgctgcttgttctctcacccctaaccctagtagttcctccactaactttctcactaagtgagaatgagaactgctgtgatagggagagtgaaggagggatatgtggtagagcacttgatttcagttgaatgcctgctggtagcttttccattctgtggagctgccgttcctaataattccaggtttggtagcgtggaggagaactttgatggaaagagaaccttcccttctgtactgttaacttaaaaataaatagctcctgattcaaa

SEQ ID NO: 137266 - DNA, 761 bp, Homo sapiens
  Payload ID: 6877
  Gene Symbol: GCNT3
  Gene Name: glucosaminyl (N-acetyl) transferase 3, mucin type
  ENST ID: ENST00000559189
  CDS Start-End: 500-761
tgcctctcaagggctggggctgcaaaacatctcagagtttgactctttgcttcgacactaccgtctgcaagttcttgtgctagccgctgtgggaaagacacagctgagtcagacatgatccctgccctcaaggagcttgtgacaccacagtgaagacaagtctattttggtgctgaagggaaacagatgaagaacatgacctcaaggagcttcctgtcaatgagaagaccaagctgacgcctggcaaagatattaaagaggagcctgaaactgttccttggacatcttatgaatgtcagaaaataccttttggagggttagaagatcaggggacatggttgttcacatttgctgccacggaacaccgccagtcttcacttggaaacagaatcacgccttgtgaagagatcatccctaagcaggagagaagctactaaaggattgtgtcctcctccaccttccctgtgctcggtctccacctgtctcccattctgtgacgatggttcaatggaagagactctgccagctgcattacttgtgggctctgggctgctatatgctgctggccactgtggctctgaaactttctttcaggttgaagtgtgactctgaccacttgggtctggagtccagggaatctcaaagccagtactgtaggaatatcttgtataatttcctgaaacttccagcaaagaggtctatcaactgttcaggggtcacccgaggggaccaagaggcagtgcttcaggctattctgaata

SEQ ID NO: 137267 - DNA, 667 bp, Homo sapiens
  Payload ID: 6877
  Gene Symbol: GCNT3
  Gene Name: glucosaminyl (N-acetyl) transferase 3, mucin type
  ENST ID: ENST00000559200
  CDS Start-End: 209-667
agttgttccttttctcctggggtggaggtggatccagatccagacttgagtgtggtcggctagtttgtagggtcagattacagatctccatcaacaaaccagatgtaaggggcttctaggcaggtctttactaaggatttttgtccaggattgtgtcctcctccaccttccctgtgctcggtctccacctgtctcccattctgtgacgatggttcaatggaagagactctgccagctgcattacttgtgggctctgggctgctatatgctgctggccactgtggctctgaaactttctttcaggttgaagtgtgactctgaccacttgggtctggagtccagggaatctcaaagccagtactgtaggaatatcttgtataatttcctgaaacttccagcaaagaggtctatcaactgttcaggggtcacccgaggggaccaagaggcagtgcttcaggctattctgaataacctggaggtcaagaagaagcgagagcctttcacagacacccactacctctccctcaccagagactgtgagcacttcaaggctgaaaggaagttcatacagttcccactgagcaaagaagaggtggagttccctattgcatactctatggtgattcatgagaagattgaaaactttgaaaggctactgcgagctgtg

SEQ ID NO: 137268 - DNA, 668 bp, Homo sapiens
  Payload ID: 6877
  Gene Symbol: GCNT3
  Gene Name: glucosaminyl (N-acetyl) transferase 3, mucin type
  ENST ID: ENST00000559626
  CDS Start-End: 509-668
aaaggctttcaagttcttgcgtgagcactgacaggcttttatgaatagttggtgacacaggtacaaactgggctgttctggctgaaatatctgtttgccttgtcggatattgccagcattcttcctgcctcactgacctccctgaatgacttgggcttgagaatgtttctgcatgatttctctgagcttgctgtcttacctgagagcaggaagtcaaaaggagagtgatggagccacctgctgccctctactttgcagatattaaagaggagcctgaaactgttccttggacatcttatgaatgtcagaaaataccttttggagggttagaagatcaggggacatggttgttcacatttgctgccacggaacaccgccagtcttcacttggaaacagaatcacgccttgtgaagagatcatccctaagcaggagagaagctactaaaggattgtgtcctcctccaccttccctgtgctcggtctccacctgtctcccattctgtgacgatggttcaatggaagagactctgccagctgcattacttgtgggctctgggctgctatatgctgctggccactgtggctctgaaactttctttcaggttgaagtgtgactctgaccacttgggtctggagtccagggaatctcaaagccagtactgtagga

SEQ ID NO: 137269 - DNA, 5554 bp, Homo sapiens
  Payload ID: 6878
  Gene Symbol: GCNT4
  Gene Name: glucosaminyl (N-acetyl) transferase 4, core 2
  Uniprot ID: Q9P109
  ENST ID: ENST00000322348
  CDS Start-End: 863-2224
tcaatgcactgttcaaggatgtttgagagattttctgtcttgcctgaatacaaaacactgtagggaacctctttgtgcttgactttgcacacacacgggatcttcagggtgggtacatttaaaactgacaagtattgccaaattgccccccaacgtagtttttacaccccacctactactctcagtgaaaaatcaggccctttttattttaagggctaaattgctaatccctgtgtgaaaatgggtgttaacaaaataaaaaataaggaaaatatgcaggcttacccaattttgttatctatacattttacagtctctaatacttagcatagctcctttgggtgtctgcccaccacccttctttctgaacgtggggttccctgggctttccttgtttgacttcagacctggatctaatagggatctggaggtagaatcaagacgaatgttccctttggccttaggtgagtcctttgcatctctgaggccctgttgatgacatccagttctctagacctctgcccaaaccagagcaatccctcctcaaatatgctaagcagaaatgcagacaatataagacacactatatttatattttaggagtttacattaccttcccttctgtttggaaaccaacatctctcaaaattaggtatagttaacacagaataccccaaaataccaccattcttcataattccatttccttatttctggattctttcaagggtaaaaaccttgtttcattcatctttggggcagcatttgcctagtatgtggtaggcgcccagtagattttggataaactgacctgattttctgttaatattccaactggattatttctttctcctcttacagaatgaagatattcaaatgttattttaaacataccctacagcagaaagttttcatcctgtttttaaccctatggctgctctctttgttaaagcttctaaatgtgagacgactctttccgcaaaaagacatttacttggttgagtactccctaagtacctcgccttttgtaagaaacagatacactcatgttaaggatgaagtcaggtatgaagttaactgttcgggtatctatgaacaggagcctttggaaattggaaagagtctggaaataagaagaagggacatcattgacttggaggatgatgatgttgtggcaatgaccagtgattgtgacatttatcagactctaagaggttatgctcaaaagcttgtctcaaaggaggagaaaagcttcccaatagcctattctttggttgtccacaaagatgcaattatggttgaaaggcttatccatgctatatacaaccagcacaatatttactgcatccattatgatcgtaaggcacctgataccttcaaagttgccatgaacaatttagctaagtgcttctccaatattttcattgcttccaaattagaggctgtggaatatgcccacatttccagactccaggctgatttaaattgcttgtcggaccttctgaagtcttcaatccagtggaaatatgttatcaacttgtgtgggcaagattttcccctgaagtcaaattttgaattggtgtcagagttgaaaaaactcaatggagcaaatatgttggagacggtgaaacccccaaacagtaaattggaaagattcacttaccatcatgaacttagacgggtgccttatgaatatgtgaagctaccaataaggacaaacatctccaaggaagcacccccccataacattcagatatttgttggcagtgcttattttgttttaagtcaagcatttgttaaatatattttcaacaactccatcgttcaagacttttttgcctggtctaaagacacatactctcctgatgagcacttttgggctaccttgattcgggttccaggaatacctggggagatttccagatcagcccaggatgtgtctgatctgcagagtaagactcgccttgtcaagtggaattactatgaaggctttttctatcccagttgtactggatctcaccttcgaagcgtgtgtatttatggagctgcagaattaaggtggcttatcaaagatggacattggtttgctaataaatttgattctaaggtggaccctatcttgattaaatgcttggcagaaaagcttgaagaacagcagagagactggatcactttgccctcagaaaagttatttatggatagaaatctcactaccacatcatgatagtaaaatcaggatggaaataagagggtgcctgataaatggagtcagtgtggaattgaataccatactatgcccaatactgtttaaactcagtcctcccatattttaaaaggtgtccaaaattccatacacaagggaaagtgatctagcctttgatgttattagcctgcagttggctaggtttttttaatatttgtttttgcttgtaatctcactgagccaaatcagagatcttaaacattcagtcagtcatcaaacattattgagcacctaactatatgacaggcacttttttagagactgcggcttatcctcatcatagcaacctcggtatctttaagttctccacataacagtcaggattctactgaagaagcttttgaagtttgtggtaatcgtctgatcatataaaccacccatttcagagtagtgtttaagtactgtgaccaacactccacttgtctcttaactcagctttcaagacatttcttaaccatcagagcagaggaggaaagactcactacctcagaaaaatctcaaagaatagtccaatttcctgcttgccaaagcataatctgccttttggtgcattacttggtcaattcagggttgaggagactgttggggggcatttataatgtatgaaagttaaggaagggggtgaggatgtgggttgggacaggtagtacctaaagaggagcgaagggatttatacaacatttttatcatgttacaaaacagtatcatgaatggcctcctttttagttcaactgtttctttaaaatgcatttactgattaaaaataagaactgaccaatagctccaagtgtcacacaccagaacattaagcctaagtcctcaattcataagttatcattctagataagtttctttacaatggaatactttctgtggaatcattataattctgttgtatggaactatcaagctaagagtcactaaactttcttcaaaaggttgtgtgaaatatgacagctttctaaattaatttgtatagtcatttaaaattttttcttctctggcaactgtccaactggaatccagatttaaagtgataaaagctctaagtttcttgcagtctttttctcagcttagttccagagagaaaaaagctaattttcctaaggacacagcaagaatattcattaaggatattttctaaaacccacacttgagaaaaccacccaatgagtcaaaaatatatatatataatatatattttatatatatgtaatatatatttatgttatatattatatatagaacaattccattacatatataatatataaatatatatattatatatacatatattgtatatgaatatatattatatatacatataattatatatatataaatatatattatataacatataatgaatatatattatatatataatggaattgttctggaagtaaaatggggtaggaatggggttctgagaataggcaataacattttcaccagtctcttgggaaattgtagaactcatgtaaaaatttcttggtcatgatatgtctcaatggcagcctcagtaaataaaaatgtagcctcagatattatatttaaagatgtagtaaatctagcccaaaataggacaatttggaagatttaagtattacatattttttaaatgtctgtgttctaaatgtgaaatgcactttgctcattttaaagttcataatactaactgccaactgacaccacttctcgctccctttcttctcttgaactcatttttctccctttttatttacccccttcaaattacttcattctttggaaataactattaccaagccccattcttcaaaataagtaaacattgtatagagccaagttctgcaaaagatccataccagttcactcgtgtgcgactgtggacaggtaagtcactttggtctctatgaacctcagttttccagatctttgaaatgagcacttggatgcctatccttgcttccacacaagtgtttttttttttttttttttttttttgtgagaatcgattgaaatagtatatgaagtggtttgaaaataggtacaaactattgacatttcaatgtcagagagtgatacctgtagtagtataggcaaaggtccaaccccatcgaaaggcttaaacatttaccttttctgaaaaactattgaaatataaagagagtccccagtcacaggggcaacttctgtaaccaaatccagatctgaggaaactcctgtaaccccatttggggtttctttctaagccaatagggttacaggttggtacagtgacacattgagaatggggctacaaatacttttcccaccatctaggatgaaatacacgaaatcctgttgaaatcttggtttttatgcctttgctcatcagaataaacgtaaatgctgaaaaacaaataacctcctgatccactgtcttgcctcctggtgagaaatgattctatcccctgtttattgggaaatttccaaagttgttcatcacttaaatgccgtattcaaagggaacatggaaggatgaagcggagaaagtgccttcgagacattcacacatttctctggactcagtctgttaacatatcagggagcttgtcagatcacacctttttgccttggaaatcctacagatttcctgtacgccttcatatctgattcttccctaaaacctttgggtatgatttcctccctggtcttgataatgtcctgcagtctgtgttttataattattctttgtatttattgaatctagactttaagttattcagagatcagaccagaaccttagagtttctaaactgtatgtggatattaaataatattaataatgaaagagctaccaaaatagtctatattgtgtgaacaatctcttgggatattagacgtgtttaaagaccagtgttgctgctatttttaatattttggttaatttaagtgaaatgtacatattttaatttgaagatttatcttgcccatcagaatgtgaagatatacttgcatatattttgacatatttcatggaaaataaaaatgataatccactttgtgagtgtaagtgaatgtattcatatgtatgttattataaatgatttttgtttgcactgatgatgaaatgagagttttgggggctttttatacatttatatcgactggtctctaaatctcctattttgttttcttatcatttttgaaatacagttcccattacatgagttttaaatagattggtgtttcattttgtattatgctactactagatgttgattctctggtattgtaaaataaaatgtgctccaaaaacccaaa

SEQ ID NO: 137270 - DNA, 2064 bp, Homo sapiens
  Payload ID: 6879
  Gene Symbol: GCNT7
  Gene Name: glucosaminyl (N-acetyl) transferase family member 7
  Uniprot ID: Q6ZNI0
  ENST ID: ENST00000243913
  CDS Start-End: 1073-1999
ataagctccacctcgagttccattaaggtattgaatgcacagtctttgttgggggaagcatttctttttttctttaatggagagtgaagttggccgcctcgaaggccaggaggactctgctcctgtcaggaaagatactcaagctatcatctgtaaacatgaacaacatttactgctggatggggaatcaccagcgcatggaagaactcttggtggatgcgttgtctggagcctgctcactccgccacgttactcagcaatgctttccctgtttctggataccacgctcccttctgaacgatgaagcatgaagcaccacgctccataaaagaccctccctctccccgtgggagggctcaggaagctatgagacctgagtatgtactgccttaaatcaacagcaacagaaggatctggtcccaaggaaatactcagagaagcaaaagcagcaacttttcaatctgcaggtcagaaccaacaggaataaaactctccagggacagatggcaacaaaacctgccaagcaactctactcaagtgactgaagcaggcgccgctgccggggaggaaccgatgggagagaaaggccaggctgggccctgacaccgccaggactccccctccaggaaccagggggcttctcctggaagcttaaaggaaaaaatacttaaattatggtaataagaatgcacctggagctcaagatatgagccagcttcgagccacaaagtctggacttgtcgtgagggcagtcatttgcatcttcatttttctttacttaaggaatccaactcctgcagaatcagaagaagaacctgcccaaccagaagtagtagaatgtggcttttacccagatgaactgtgttccgctttatttgaagggaaaggggcggccccctaaattgcaaaattttgcaaaacccctcataaatctgaaatacatgctcatttacacacaccaggaaactgctccaggatttctcgggggctgcatttcataaccagacccctgtctgcagaagagggcgatttctctttggcatatattataactattcataaggagctggccatgtttgtgcagcttctcagagctatttatgtacctcaaaatgtttattgtattcatgttgatgaaaaggccccaatgaagtataagactgctgtgcaaaccttggttaactgttttgaaaacgtttttatttcctccaagacagagaaggtggcttatgctggctttacaagactacaggcagatattaattgtatgaaagttctagtgcattctaaatttcaatggaactatgtcatcaatctttgtggacaggattttcccatcaaaaccaacagagaaatcatacactacatcagaagcaaatggagtgataaaaatattactcctggagtaatccaaccattgcacattaaatccaagacaagtcaaagtcatctcgaattcgttcctaaaggaagtatctatgcacctccaaataacagattcaaagacaaaccaccccataacttaaccatttattttggaagtgcttactatgtacttacaaggaagtttgtagagttcatactgactgacatccatgcaaaagacatgcttcagtggtccaaagacatccgcagcccagagcaacactactgggtgaccctgaaccgactaaaagatgctccaggtgctacaccaaacgctggctgggaaggaaatgttcgagccattaagcggaaaagtgaggaaggaaatgttcatgatggatgtaaaggccgctacgtcgaagacatctgcgtatacggaccaggagacctgccgtggctcattcagtcgccttctctgtttgccaacaaattcgaaccctcgacagacccgcttgtggttacctgcttagagcggcggcacagacttcaagtgctgaggcaggcagaagttcctatagagccacactggcattttcaacagcagagtcatttcaatatgagactgaaccgctagggagtgtttgctttcttactggtatcattctgtttccttgacttgaaacaagagaacattgaacc

SEQ ID NO: 137271 - DNA, 1355 bp, Homo sapiens
  Payload ID: 6879
  Gene Symbol: GCNT7
  Gene Name: glucosaminyl (N-acetyl) transferase family member 7
  ENST ID: ENST00000617620
  CDS Start-End: 1-1290
atgagccagcttcgagccacaaagtctggacttgtcgtgagggcagtcatttgcatcttcatttttctttacttaaggaatccaactcctgcagaatcagaagaagaacctgcccaaccagaagtagtagaatgtggcttttacccagatgaactgtgttccgctttatttgaagggaaaggggcggcccccattgcaaaattttgcaaaacccctcataaatctgaaatacatgctcatttacacacaccaggaaactgctccaggatttctcgggggctgcatttcataaccagacccctgtctgcagaagagggcgatttctctttggcatatattataactattcataaggagctggccatgtttgtgcagcttctcagagctatttatgtacctcaaaatgtttattgtattcatgttgatgaaaaggccccaatgaagtataagactgctgtgcaaaccttggttaactgttttgaaaacgtttttatttcctccaagacagagaaggtggcttatgctggctttacaagactacaggcagatattaattgtatgaaagttctagtgcattctaaatttcaatggaactatgtcatcaatctttgtggacaggattttcccatcaaaaccaacagagaaatcatacactacatcagaagcaaatggagtgataaaaatattactcctggagtaatccaaccattgcacattaaatccaagacaagtcaaagtcatctcgaattcgttcctaaaggaagtatctatgcacctccaaataacagattcaaagacaaaccaccccataacttaaccatttattttggaagtgcttactatgtacttacaaggaagtttgtagagttcatactgactgacatccatgcaaaagacatgcttcagtggtccaaagacatccgcagcccagagcaacactactgggtgaccctgaaccgactaaaagatgctccaggtgctacaccaaacgctggctgggaaggaaatgttcgagccattaagcggaaaagtgaggaaggaaatgttcatgatggatgtaaaggccgctacgtcgaagacatctgcgtatacggaccaggagacctgccgtggctcattcagtcgccttctctgtttgccaacaaattcgaaccctcgacagacccgcttgtggttacctgcttagagcggcggcacagacttcaagtgctgaggcaggcagaagttcctatagagccacactggcattttcaacagcagagtcatttcaatatgagactgaaccgctagggagtgtttgctttcttactggtatcattctgtttccttgacttgaaacaagagaacattgaacc

SEQ ID NO: 137272 - DNA, 1533 bp, Homo sapiens
  Payload ID: 6880
  Gene Symbol: G6PC3
  Gene Name: glucose 6 phosphatase, catalytic, 3
  Uniprot ID: Q9BUM1
  ENST ID: ENST00000269097
  CDS Start-End: 232-1272
agtagggaggaaaaccggaggagagcgcaggaggaaacagtaccggctggaggccggtcttgcaggagcgggggactgctgggggcggggcttggtggtgaccgctggcggggcggggcctggggctcagaggggtgggctttggagatcagagggtcgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtggtttctttttggagacaggcccttttggtgggtccatgagtctggttactacagccaggctccagcccaggttcaccagttcccctcttcttgtgagactggtccaggcagcccttctggacactgcatgatcacaggagcagccctctggcccataatgacggccctgtcttcgcaggtggccactcgggcccgcagccgctgggtaagggtgatgcctagcctggcttattgcaccttccttttggcggttggcttgtcgcgaatcttcatcttagcacatttccctcaccaggtgctggctggcctaataactggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggg

SEQ ID NO: 137273 - DNA, 844 bp, Homo sapiens
  Payload ID: 6880
  Gene Symbol: G6PC3
  Gene Name: glucose 6 phosphatase, catalytic, 3
  ENST ID: ENST00000590253
  CDS Start-End: 1-209
cggccctgtcttcgcaggtggccactcgggcccgcaggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggggcagccagggcggccccaataaagcccttgaatactttga

SEQ ID NO: 137274 - DNA, 710 bp, Homo sapiens
  Payload ID: 6880
  Gene Symbol: G6PC3
  Gene Name: glucose 6 phosphatase, catalytic, 3
  ENST ID: ENST00000593115
  CDS Start-End: 222-443
aaaaccggaggagagcgcaggaggaaacagtaccggctggaggccggtcttgcaggagcgggggactgctgggggcggggcttggtggtgaccgctggcggggcggggcctggggctcagaggggtgggctttggagatcagagggtcgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtggtgagacagagaagccctccggcatcctggtccccacccccgagggccctgagtcatgtaagcatgctttgtgctgggcatcacggtagctgctaaggacagagacaccttgcagattaaggtgtggtccctggaccatgcccaacggcataggcagcacttgaaaactggctaaaaacgcagactctcaggccccgggccagagctactgaatcaaaatctgcattttaacaaggttcccaggtttctttttggagacaggcccttttgg

SEQ ID NO: 137275 - DNA, 1572 bp, Homo sapiens
  Payload ID: 6880
  Gene Symbol: G6PC3
  Gene Name: glucose 6 phosphatase, catalytic, 3
  ENST ID: ENST00000585361
  CDS Start-End: 216-437
ggaggagagcgcaggaggaaacagtaccggctggaggccggtcttgcaggagcgggggactgctgggggcggggcttggtggtgaccgctggcggggcggggcctggggctcagaggggtgggctttggagatcagagggtcgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtggtgagacagagaagccctccggcatcctggtccccacccccgagggccctgagtcatgtgtttctttttggagacaggcccttttggtgggtccatgagtctggttactacagccaggctccagcccaggttcaccagttcccctcttcttgtgagactggtccaggcagcccttctggacactgcatgatcacaggagcagccctctggcccataatgacggccctgtcttcgcaggtggccactcgggcccgcagccgctgggtaagggtgatgcctagcctggcttattgcaccttccttttggcggttggcttgtcgcgaatcttcatcttagcacatttccctcaccaggtgctggctggcctaataactggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtg

SEQ ID NO: 137276 - DNA, 1718 bp, Homo sapiens
  Payload ID: 6880
  Gene Symbol: G6PC3
  Gene Name: glucose 6 phosphatase, catalytic, 3
  ENST ID: ENST00000588558
  CDS Start-End: 217-435
cggaggagagcgcaggaggaaacagtaccggctggaggccggtcttgcaggagcgggggactgctgggggcggggcttggtggtgaccgctggcggggcggggcctggggctcagaggggtgggctttggagatcagagggtcgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtgaagcatgctttgtgctgggcatcacggtagctgctaaggacagagacaccttgcagattaaggtgtggtccctggaccatgcccaacggcataggcagcacttgaaaactggctaaaaacgcagactctcaggccccgggccagagctactgaatcaaaatctgcattttaacaaggttcccaggtgattccctgtttctttttggagacaggcccttttggtgggtccatgagtctggttactacagccaggctccagcccaggttcaccagttcccctcttcttgtgagactggtccaggcagcccttctggacactgcatgatcacaggagcagccctctggcccataatgacggccctgtcttcgcaggtggccactcgggcccgcagccgctgggtaagggtgatgcctagcctggcttattgcaccttccttttggcggttggcttgtcgcgaatcttcatcttagcacatttccctcaccaggtgctggctggcctaataactggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggggcagcc

SEQ ID NO: 137277 - DNA, 805 bp, Homo sapiens
  Payload ID: 6880
  Gene Symbol: G6PC3
  Gene Name: glucose 6 phosphatase, catalytic, 3
  ENST ID: ENST00000591696
  CDS Start-End: 75-805
cgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtggtttctttttggagacaggcccttttggtgggtccatgagtctggttactacagccaggctccagcccaggtggccactcgggcccgcagccgctgggtaagggtgatgcctagcctggcttattgcaccttccttttggcggttggcttgtcgcgaatcttcatcttagcacatttccctcaccaggtgctggctggcctaataactggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaa

SEQ ID NO: 137278 - DNA, 3096 bp, Homo sapiens
  Payload ID: 6881
  Gene Symbol: G6PC
  Gene Name: glucose-6-phosphatase, catalytic subunit
  Uniprot ID: P35575
  ENST ID: ENST00000253801
  CDS Start-End: 80-1153
tagcagagcaatcaccaccaagcctggaataactgcaagggctctgctgacatcttcctgaggtgccaaggaaatgaggatggaggaaggaatgaatgttctccatgactttgggatccagtcaacacattacctccaggtgaattaccaagactcccaggactggttcatcttggtgtccgtgatcgcagacctcaggaatgccttctacgtcctcttccccatctggttccatcttcaggaagctgtgggcattaaactcctttgggtagctgtgattggagactggctcaacctcgtctttaagtggattctctttggacagcgtccatactggtgggttttggatactgactactacagcaacacttccgtgcccctgataaagcagttccctgtaacctgtgagactggaccagggagcccctctggccatgccatgggcacagcaggtgtatactacgtgatggtcacatctactctttccatctttcagggaaagataaagccgacctacagatttcggtgcttgaatgtcattttgtggttgggattctgggctgtgcagctgaatgtctgtctgtcacgaatctaccttgctgctcattttcctcatcaagttgttgctggagtcctgtcaggcattgctgttgcagaaactttcagccacatccacagcatctataatgccagcctcaagaaatattttctcattaccttcttcctgttcagcttcgccatcggattttatctgctgctcaagggactgggtgtagacctcctgtggactctggagaaagcccagaggtggtgcgagcagccagaatgggtccacattgacaccacaccctttgccagcctcctcaagaacctgggcacgctctttggcctggggctggctctcaactccagcatgtacagggagagctgcaaggggaaactcagcaagtggctcccattccgcctcagctctattgtagcctccctcgtcctcctgcacgtctttgactccttgaaacccccatcccaagtcgagctggtcttctacgtcttgtccttctgcaagagtgcggtagtgcccctggcatccgtcagtgtcatcccctactgcctcgcccaggtcctgggccagccgcacaagaagtcgttgtaagagatgtggagtcttcggtgtttaaagtcaacaaccatgccagggattgaggaggactactatttgaagcaatgggcactggtatttggagcaagtgacatgccatccattctgccgtcgtggaattaaatcacggatggcagattggagggtcgcctggcttattcccatgtgtgactccagcctgccctcagcacagactctttcagatggaggtgccatatcacgtacaccatatgcaagtttcccgccaggaggtcctcctctctctacttgaatactctcacaagtagggagctcactcccactggaacagcccattttatctttgaatggtcttctgccagcccattttgaggccagaggtgctgtcagctcaggtggtcctcttttacaatcctaatcatattgggtaatgtttttgaaaagctaatgaagctattgagaaagacctgttgctagaagttgggttgttctggattttcccctgaagacttacttattcttccgtcacatatacaaaagcaagacttccaggtagggccagctcacaagcccaggctggagatcctaactgagaattttctacctgtgttcattcttaccgagaaaaggagaaaggagctctgaatctgataggaaaagaaggctgcctaaggaggagtttttagtatgtggcgtatcatgcaagtgctatgccaagccatgtctaaatggctttaattatatagtaatgcactctcagtaatgggggaccagcttaagtataattaatagatggttagtggggtaattctgcttctagtattttttttactgtgcatacatgttcatcgtatttccttggatttctgaatggctgcagtgacccagatattgcactaggtcaaaacattcaggtatagctgacatctcctctatcacattacatcatcctccttataagcccagctctgctttttccagattcttccactggctccacatccaccccactggatcttcagaaggctagagggcgactctggtggtgcttttgtatgtttcaattaggctctgaaatcttgggcaaaatgacaaggggagggccaggattcctctctcaggtcactccagtgttacttttaattcctagagggtaaatatgactcctttctctatcccaagccaaccaagagcacattcttaaaggaaaagtcaacatcttctctctttttttttttttttgagacagggtctcactatgttgcccaggctgctcttgaattcctgggctcaagcagtcctcccaccctaccacagcgtcccgcgtagctgggactacaggtgcaagccactatgtccagctagccaactcctccttgcctgcttttctttttttttctttttttgagacggcgcacctatcacccaggctggagtggagtggcacgatcttggctcactgcaacctcttcctcctggttcaagcgattctcatgtctcagcctcctcagtagctaggactaccggcgtgcaccaccatgccaggctaatttttatatttttagaattttagaagagatgggatttcatcatgttggccaggctggtctcgaactcctgacctcaagtgatccacctgccttggcctcccaaggtgctaggattacaggcatgagccaccgcaccgggccctccttgcctgtttttcaatctcatctgatatgcagagtatttctgccccacccacctaccccccaaaaaaagctgaagcctatttatttgaaagtccttgtttttgctactaattatatagtataccatacattatcattcaaaacaaccatcctgctcataacatctttgaaaagaaaaatatatatgtgcagtattttattaaagcaacattttatttaagaataaagtcttgttaattactatattttagatgcaatgtgatc

SEQ ID NO: 137279 - DNA, 987 bp, Homo sapiens
  Payload ID: 6881
  Gene Symbol: G6PC
  Gene Name: glucose-6-phosphatase, catalytic subunit
  Uniprot ID: P35575
  ENST ID: ENST00000592383
  CDS Start-End: 81-611
atagcagagcaatcaccaccaagcctggaataactgcaagggctctgctgacatcttcctgaggtgccaaggaaatgaggatggaggaaggaatgaatgttctccatgactttgggatccagtcaacacattacctccaggtgaattaccaagactcccaggactggttcatcttggtgtccgtgatcgcagacctcaggaatgccttctacgtcctcttccccatctggttccatcttcaggaagctgtgggcattaaactcctttgggtagctgtgattggagactggctcaacctcgtctttaagtggattctctttggacagcgtccatactggtgggttttggatactgactactacagcaacacttccgtgcccctgataaagcagttccctgtaacctgtgagactggaccagggaaagataaagccgacctacagatttcggtgcttgaatgtcattttgtggttgggattctgggctgtgcagctgaatgtctgtctgtcacgaatctaccttgctgctcattttcctcatcaagttgttgctggagtcctgtcaggcattgctgttgcagaaactttcagccacatccacagcatctataatgccagcctcaagaaatattttctcattaccttcttcctgttcagcttcgccatcggattttatctgctgctcaagggactgggtgtagacctcctgtggactctggagaaagcccagaggtggtgcgagcagccagaatgggtccacattgacaccacaccctttgccagcctcctcaagaacctgggcacgctctttggcctggggctggctctcaactccagcatgtacagggagagctgcaaggggaaactcagcaagtggctcccattccgcctcagctctattgtagcctccctcgtcctcctgcacgtctttgactccttgaaacccccatcccaagtcgagctggtcttctacgtcttgtccttctgc

SEQ ID NO: 137280 - DNA, 1097 bp, Homo sapiens
  Payload ID: 6881
  Gene Symbol: G6PC
  Gene Name: glucose-6-phosphatase, catalytic subunit
  ENST ID: ENST00000585489
  CDS Start-End: 78-569
gcagagcaatcaccaccaagcctggaataactgcaagggctctgctgacatcttcctgaggtgccaaggaaatgaggatggaggaaggaatgaatgttctccatgactttgggatccagtcaacacattacctccaggtgaattaccaagactcccaggactggttcatcttggtgtccgtgatcgcagacctcaggaatgccttctacgtcctcttccccatctggttccatcttcaggaagctgtgggcattaaactcctttgggtagctgtgattggagactggctcaacctcgtctttaagtggattctctttggacagcgtccatactggtgggttttggatactgactactacagcaacacttccgtgcccctgataaagcagttccctgtaacctgtgagactggaccagggagcccctctggccatgccatgggcacagcaggtgtatactacgtgatggtcacatctactctttccatctttcagggaaagataaagccgacctacagatttcggcattgctgttgcagaaactttcagccacatccacagcatctataatgccagcctcaagaaatattttctcattaccttcttcctgttcagcttcgccatcggattttatctgctgctcaagggactgggtgtagacctcctgtggactctggagaaagcccagaggtggtgcgagcagccagaatgggtccacattgacaccacaccctttgccagcctcctcaagaacctgggcacgctctttggcctggggctggctctcaactccagcatgtacagggagagctgcaaggggaaactcagcaagtggctcccattccgcctcagctctattgtagcctccctcgtcctcctgcacgtctttgactccttgaaacccccatcccaagtcgagctggtcttctacgtcttgtccttctgcaagagtgcggtagtgcccctggcatccgtcagtgtcatcccctactgcctcgcccaggtcctgggccagccgcacaagaagtcgttgtaagagatgtggagtcttcggtgtttaaagtcaacaaccatgccagggattgaggaggactacta

SEQ ID NO: 137281 - DNA, 2918 bp, Homo sapiens
  Payload ID: 6882
  Gene Symbol: G6PC2
  Gene Name: glucose-6-phosphatase, catalytic, 2
  Uniprot ID: Q9NQR9
  ENST ID: ENST00000282075
  CDS Start-End: 40-348
ctccaattgctctatgtttagaattgcctctttttcaagatggatttccttcacaggaatggagtgctcataattcagcatttgcagaaggactaccgagcttactacacttttctaaattttatgtccaatgttggagaccccaggaatatctttttcatttattttccactttgttttcaatttaatcagacagttggaaccaagatgatatgggtagcagtcattggggattggttaaatcttatatttaaatggaagtccatctggccatgcaatgggcgcatcctgtgtctggtatgtcatggtaaccgctgccctgagccacactgtctgtgggatggataagttctctatcactctgcacagactgacctggtcatttctttggagtgttttttggttgattcaaatcagtgtctgcatctccagagtattcatagcaacacattttcctcatcaagttattcttggagtaattggtggcatgctggtggcagaggcctttgaacacactccaggcatccaaacggccagtctgggcacatacctgaagaccaacctctttctcttcctgtttgcagttggcttttacctgcttcttagggtgctcaacattgacctgctgtggtccgtgcccatagccaaaaagtggtgtgctaaccccgactggatccacattgacaccacgccttttgctggactcgtgagaaaccttggggtcctctttggcttgggctttgcaatcaactcagagatgttcctcctgagctgccgagggggaaataactacacactgagcttccggttgctctgtgccttgacctcattgacaatactgcagctctaccatttcctccagatcccgactcacgaagagcatttattttatgtgctgtctttttgtaaaagtgcatccattcccctaactgtggttgctttcattccctactctgttcatatgttaatgaaacaaagcggaaagaagagtcagtagagtggtgcctagagttagtgctctgtgtcacagatcacccttctccatccaccagtagagccacagagtaggcacagaccagaggcttctaatccgacttcacagaatagcggcacaggccccattccccatagagatgtttagtttggccttcgcactggtctttttttttaatccttcagttaccaatatttagatacaagaatatttgacataaaaatcggaagttctgtatttcttgaaaaatctgatagtatgacaacacagagcctgcatccccagctggagacaactgaccagagctgcatactaacagtccccagtaggaggcaaggactccattttctcacagtcttcagcatcccagcaggagccccactatgattcctttatcttcttaaggccaggctgcatctgattcctgttgacattttagtggggaccacagccatatccagtttcagttttcagatgaggaaatggaagcctatttaggtaaaagaacttgcctggagtcacgccaccttcagagcaggaattagaacccaaggcttctgacacatatccccattacactgtgtgtttgagtgtgcacacatgcacatgctttttgtttgtatgtttcctttttagaaccagggacttgctctgttgcccaggctggagtgcagtggtggatagcggctcactgcagcctcaaactcctggctcaaatgatcctccctcctcagcctcccattagctaagactacaggtgtgcaccaccatgcctggctaatttttgaatattttttagagccagcttcttactatatttgcccaggctggtcttgaactcctggcctcaaggagttcccttgaggatgttccacccatgtcagcctcccacagtgctgggattgcaggcttgagccattgtattaatagttggcctacactgtcttttgtttcttcatttacaagaggtaaaaatcagtaagaatgaatgctttcatttagattctatgatgactgccatataaatcagctaccttttcagaaatgacattgaaatactgcatcctctttgacttataccccacacatacatgcagggtctaggtgggaccaacagtggctccagatgtatatacacacgggtccagggacaacagaacaggccaggctacagtatggacttgaacctctgcttcacttctggtctctgttttacagtagtgctcaccaatatttcaataaattctactgaacttactctaatagaacattattcaacccccaaagacttatctcttcactatgacatctccatactttatttttaggagacagactttcaaaaccagagaaatcaggtgccttcctcaaggtcatgctccaacccaggccaactattaaatgcttgcatctgttagctggattagtctctatgtatactgaactgtgatgaaaatctatagctttgttttagaaaattattgttgatggactattaatattatattaacaatttctcagtaagtgtgttttttcctcattgaatctaggaatgctgggctttaagttgataactgtgtcatttcaatcaagtacaaggattttgaggcagattttgctagatatcttagtaatcccccacaatgttttatgtaactcttctcagaatatcaatacattaattattttagatgacatattaaataatctatgaatattaatgaaaacaatacagttgaagtgagtgttgtttaacatgatagtagctgaggataacaaacctcaaaaaatcaaagtattaattactcctttccaagtatatgtatagagcatgtgtcattgcttttataaaacgcacttaatagctttctttctaaaaggcaactgaactttctaaaaggtaaataaactgaacttgatatta

SEQ ID NO: 137282 - DNA, 1214 bp, Homo sapiens
  Payload ID: 6882
  Gene Symbol: G6PC2
  Gene Name: glucose-6-phosphatase, catalytic, 2
  Uniprot ID: Q9NQR9
  ENST ID: ENST00000375363
  CDS Start-End: 93-1160
tcgacatgccacaaaggcacagtataaaaacggtgggaatcagagcacttcagctccaattgctctatgtttagaattgcctctttttcaagatggatttccttcacaggaatggagtgctcataattcagcatttgcagaaggactaccgagcttactacacttttctaaattttatgtccaatgttggagaccccaggaatatctttttcatttattttccactttgttttcaatttaatcagacagttggaaccaagatgatatgggtagcagtcattggggattggttaaatcttatatttaaatggatattatttggtcatcgaccttactggtgggtccaagaaactcagatttacccaaatcactcaagtccatgccttgaacagttccctactacatgtgaaacaggtccaggaagtccatctggccatgcaatgggcgcatcctgtgtctggtatgtcatggtaaccgctgccctgagccacactgtctgtgggatggataagttctctatcactctgcacagactgacctggtcatttctttggagtgttttttggttgattcaaatcagtgtctgcatctccagagtattcatagcaacacattttcctcatcaagttattcttggagtaattggtggcatgctggtggcagaggcctttgaacacactccaggcatccaaacggccagtctgggcacatacctgaagaccaacctctttctcttcctgtttgcagttggcttttacctgcttcttagggtgctcaacattgacctgctgtggtccgtgcccatagccaaaaagtggtgtgctaaccccgactggatccacattgacaccacgccttttgctggactcgtgagaaaccttggggtcctctttggcttgggctttgcaatcaactcagagatgttcctcctgagctgccgagggggaaataactacacactgagcttccggttgctctgtgccttgacctcattgacaatactgcagctctaccatttcctccagatcccgactcacgaagagcatttattttatgtgctgtctttttgtaaaagtgcatccattcccctaactgtggttgctttcattccctactctgttcatatgttaatgaaacaaagcggaaagaagagtcagtagagtggtgcctagagttagtgctctgtgtcacagatcacccttctccatccacca

SEQ ID NO: 137283 - DNA, 494 bp, Homo sapiens
  Payload ID: 6882
  Gene Symbol: G6PC2
  Gene Name: glucose-6-phosphatase, catalytic, 2
  ENST ID: ENST00000421979
  CDS Start-End: 8-250
tttcaagatggatttccttcacaggaatggagtgctcataattcagcatttgcagaaggactaccgagcttactacacttttctaaattttatgtccaatgttggagaccccaggaatatctttttcatttattttccactttgttttcaatttaatcagacagttggaaccaagatgatatgggtagcagtcattggggattggttaaatcttatatttaaatggcatgctggtggcagaggcctttgaacacactccaggcatccaaacggccagtctgggcacatacctgaagaccaacctctttctcttcctgtttgcagttggcttttacctgcttcttagggtgctcaacattgacctgctgtggtccgtgcccatagccaaaaagtggtgtgctaaccccgactggatccacattgacaccacgccttttgctggactcgtgagaaaccttggggtcctctttggcttgggctttgcaatcaactca

SEQ ID NO: 137284 - DNA, 645 bp, Homo sapiens
  Payload ID: 6882
  Gene Symbol: G6PC2
  Gene Name: glucose-6-phosphatase, catalytic, 2
  Uniprot ID: Q9NQR9
  ENST ID: ENST00000429379
  CDS Start-End: 42-506
agctccaattgctctatgtttagaattgcctctttttcaagatggatttccttcacaggaatggagtgctcataattcagcatttgcagaaggactaccgagcttactacacttttctaaattttatgtccaatgttggagaccccaggaatatctttttcatttattttccactttgttttcaatttaatcagacagttggaaccaagatgatatgggtagcagtcattggggattggttaaatcttatatttaaatggatattatttggtcatcgaccttactggtgggtccaagaaactcagatttacccaaatcactcaagtccatgccttgaacagttccctactacatgtgaaacaggtccaggaagtccatctggccatgcaatgggcgcatcctgtgtctggtatgtcatggtaaccgctgccctgagccacactgtctgtgggatggataagttctctatcactctgcacaggcatgctggtggcagaggcctttgaacacactccaggcatccaaacggccagtctgggcacatacctgaagaccaacctctttctcttcctgtttgcagttggcttttacctgcttcttagggtgctcaacattgacctgctgtggtccgtgcccatagccaaa

SEQ ID NO: 137285 - DNA, 494 bp, Homo sapiens; identical to SEQ ID NO: 137283
  Payload ID: 6882
  Gene Symbol: G6PC2
  Gene Name: glucose-6-phosphatase, catalytic, 2
  ENST ID: ENST00000618310
  CDS Start-End: 8-250

SEQ ID NO: 137286 - DNA, 645 bp, Homo sapiens; identical to SEQ ID NO: 137284
  Payload ID: 6882
  Gene Symbol: G6PC2
  Gene Name: glucose-6-phosphatase, catalytic, 2
  Uniprot ID: Q9NQR9
  ENST ID: ENST00000612807
  CDS Start-End: 42-506

SEQ ID NO: 137287 - DNA, 1214 bp, Homo sapiens; identical to SEQ ID NO: 137282
  Payload ID: 6882
  Gene Symbol: G6PC2
  Gene Name: glucose-6-phosphatase, catalytic, 2
  Uniprot ID: Q9NQR9
  ENST ID: ENST00000622133
  CDS Start-End: 93-1160

SEQ ID NO: 137288 - DNA, 2913 bp, Homo sapiens
  Payload ID: 6882
  Gene Symbol: G6PC2
  Gene Name: glucose-6-phosphatase, catalytic, 2
  Uniprot ID: Q9NQR9
  ENST ID: ENST00000617403
  CDS Start-End: 40-348
ctccaattgctctatgtttagaattgcctctttttcaagatggatttccttcacaggaatggagtgctcataattcagcatttgcagaaggactaccgagcttactacacttttctaaattttatgtccaatgttggagaccccaggaatatctttttcatttattttccactttgttttcaatttaatcagacagttggaaccaagatgatatgggtagcagtcattggggattggttaaatcttatatttaaatggaagtccatctggccatgcaatgggcgcatcctgtgtctggtatgtcatggtaaccgctgccctgagccacactgtctgtgggatggataagttctctatcactctgcacagactgacctggtcatttctttggagtgttttttggttgattcaaatcagtgtctgcatctccagagtattcatagcaacacattttcctcatcaagttattcttggagtaattggtggcatgctggtggcagaggcctttgaacacactccaggcatccaaacggccagtctgggcacatacctgaagaccaacctctttctcttcctgtttgcagttggcttttacctgcttcttagggtgctcaacattgacctgctgtggtccgtgcccatagccaaaaagtggtgtgctaaccccgactggatccacattgacaccacgccttttgctggactcgtgagaaaccttggggtcctctttggcttgggctttgcaatcaactcagagatgttcctcctgagctgccgagggggaaataactacacactgagcttccggttgctctgtgccttgacctcattgacaatactgcagctctaccatttcctccagatcccgactcacgaagagcatttattttatgtgctgtctttttgtaaaagtgcatccattcccctaactgtggttgctttcattccctactctgttcatatgttaatgaaacaaagcggaaagaagagtcagtagagtggtgcctagagttagtgctctgtgtcacagatcacccttctccatccaccagtagagccacagagtaggcacagaccagaggcttctaatccgacttcacagaatagcggcacaggccccattccccatagagatgtttagtttggccttcgcactggtctttttttttaatccttcagttaccaatatttagatacaagaatatttgacataaaaatcggaagttctgtatttcttgaaaaatctgatagtatgacaacacagagcctgcatccccagctggagacaactgaccagagctgcatactaacagtccccagtaggaggcaaggactccattttctcacagtcttcagcatcccagcaggagccccactatgattcctttatcttcttaaggccaggctgcatctgattcctgttgacattttagtggggaccacagccatatccagtttcagttttcagatgaggaaatggaagcctatttaggtaaaagaacttgcctggagtcacgccaccttcagagcaggaattagaacccaaggcttctgacacatatccccattacactgtgtgtttgagtgtgcacacatgcacatgctttttgtttgtatgtttcctttttagaaccagggacttgctctgttgcccaggctggagtgcagtggtggatagcggctcactgcagcctcaaactcctggctcaaatgatcctccctcctcagcctcccattagctaagactacaggtgtgcaccaccatgcctggctaatttttgaatattttttagagccagcttcttactatatttgcccaggctggtcttgaactcctggcctcaaggagttcccttgaggatgttccacccatgtcagcctcccacagtgctgggattgcaggcttgagccattgtattaatagttggcctacactgtcttttgtttcttcatttacaagaggtaaaaatcagtaagaatgaatgctttcatttagattctatgatgactgccatataaatcagctaccttttcagaaatgacattgaaatactgcatcctctttgacttataccccacacatacatgcagggtctaggtgggaccaacagtggctccagatgtatatacacacgggtccagggacaacagaacaggccaggctacagtatggacttgaacctctgcttcacttctggtctctgttttacagtagtgctcaccaatatttcaataaattctactgaacttactctaatagaacattattcaacccccaaagacttatctcttcactatgacatctccatactttatttttaggagacagactttcaaaaccagagaaatcaggtgccttcctcaaggtcatgctccaacccaggccaactattaaatgcttgcatctgttagctggattagtctctatgtatactgaactgtgatgaaaatctatagctttgttttagaaaattattgttgatggactattaatattatattaacaatttctcagtaagtgtgttttttcctcattgaatctaggaatgctgggctttaagttgataactgtgtcatttcaatcaagtacaaggattttgaggcagattttgctagatatcttagtaatcccccacaatgttttatgtaactcttctcagaatatcaatacattaattattttagatgacatattaaataatctatgaatattaatgaaaacaatacagttgaagtgagtgttgtttaacatgatagtagctgaggataacaaacctcaaaaaatcaaagtattaattactcctttccaagtatatgtatagagcatgtgtcattgcttttataaaacgcacttaatagctttctttctaaaaggcaactgaactttctaaaaggtaaataaactgaacttga

SEQ ID NO: 137289 - DNA, 1799 bp, Homo sapiens
  Payload ID: 6883
  Gene Symbol: G6PD
  Gene Name: glucose-6-phosphate dehydrogenase
  Uniprot ID: P11413
  ENST ID: ENST00000369620
  CDS Start-End: 114-1799
cgagaactcgggaagccggcgagaagtgtgaggccgcggtagggccgcatcccgctccggagagaagtctgagtccgccaggctctgcaggcccgcggaagctcgacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccggggacctggaagacaagggggatcaggaagtgagtcttgcagcttgtcactaggaagccttgtttggggtccccatgcccttgaaccaggtgaacagggcggggagctaaggcgagctctggcctcttccgtccccagggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctatgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctga

SEQ ID NO: 137290 - DNA, 2631 bp, Homo sapiens
  Payload ID: 6883
  Gene Symbol: G6PD
  Gene Name: glucose-6-phosphate dehydrogenase
  Uniprot ID: P11413
  ENST ID: ENST00000393562
  CDS Start-End: 385-2022
agggacagcccagaggaggcgtggccacgctgccggcggaagtggagccctccgcgagcgcgcgaggccgccggggcaggcggggaaaccggacagtaggggcggggccgggccggcgatggggatgcgggagcactacgcggagctgcacccgtgcccgccggaattggggatgcagagcagcggcagcgggtatggcaggcagccggcgggccggcctccagcgcaggtgcccgagaggcaggggctggcctgggatgcgcgcgcacctgccctcgccccgccccgcccgcacgaggggtggtggccgaggccccgccccgcacgcctcgcctgaggcgggtccgctcagcccaggcgcccgcccccgcccccgccgattaaatgggccggcggggctcagcccccggaaacggtcgtacacttcggggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctatgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacgagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcc

SEQ ID NO: 137291 - DNA, 1661 bp, Homo sapiens
  Payload ID: 6883
  Gene Symbol: G6PD
  Gene Name: glucose-6-phosphate dehydrogenase
  Uniprot ID: P11413
  ENST ID: ENST00000393564
  CDS Start-End: 114-1661
cgagaactcgggaagccggcgagaagtgtgaggccgcggtagggccgcatcccgctccggagagaagtctgagtccgccaggctctgcaggcccgcggaagctcgacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctatgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctga

SEQ ID NO: 137292 - DNA, 817 bp, Homo sapiens
  Payload ID: 6883
  Gene Symbol: G6PD
  Gene Name: glucose-6-phosphate dehydrogenase
  ENST ID: ENST00000433845
  CDS Start-End: 49-817
acttcggggctgcgagcgcggagggcgacgacgacgaagcgcagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatcc

SEQ ID NO: 137293 - DNA, 1074 bp, Homo sapiens
  Payload ID: 6883
  Gene Symbol: G6PD
  Gene Name: glucose-6-phosphate dehydrogenase
  ENST ID: ENST00000439227
  CDS Start-End: 59-1074
tcgtacacttcggggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagatcagaggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgc

SEQ ID NO: 137294 - DNA, 1056 bp, Homo sapiens
  Payload ID: 6883
  Gene Symbol: G6PD
  Gene Name: glucose-6-phosphate dehydrogenase
  ENST ID: ENST00000440967
  CDS Start-End: 95-1056
ccggcgagaagtgtgaggccgcggtagggccgcatcccgctccggagagaagtctgagtccgccaggctctgcaggcccgcggaagctcgcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagatcagaggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaa

SEQ ID NO: 137295 - DNA, 2631 bp, Homo sapiens; identical to SEQ ID NO: 137290
  Payload ID: 6883
  Gene Symbol: G6PD
  Gene Name: glucose-6-phosphate dehydrogenase
  Uniprot ID: P11413
  ENST ID: ENST00000621232
  CDS Start-End: 475-2022

SEQ ID NO: 137296 - DNA, 2210 bp, Homo sapiens
  Payload ID: 6884
  Gene Symbol: GPI
  Gene Name: glucose-6-phosphate isomerase
  Uniprot ID: P06744
  ENST ID: ENST00000356487
  CDS Start-End: 242-1918
agagaggagctgaggccccagatcagcggccgcgggcaaggtcgctcagcgggcacccggcctgggtatcggggcgcgggtcgggggcggggccggggctcaggggtggggccgggccgggccgggccgggcgcctgcgccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggagga

SEQ ID NO: 137297 - DNA, 4000 bp, Homo sapiens
  Payload ID: 6884
  Gene Symbol: GPI
  Gene Name: glucose-6-phosphate isomerase
  Uniprot ID: P06744
  ENST ID: ENST00000415930
  CDS Start-End: 171-1880
aatagcccttaccaccagcagacacacatcatctgttgtacttgcttatttggcacatatgtatccacagcgcctagaacactgcctgtaacgtggaaggtgttcgatctatagagttttgtcgaatgaatgaatgaagccgactagtgcacagggagtgcagcggcgcgatggtagctctctgcagcctccaacacctgggctccagtgatccccgggctctgcccaccctccccactgccacttccgggcagaggccagcaaagcggcggcgcaagagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactgcagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggttcaagctattctcctgcctcagcctcccgagtagctgggattacacggcgcacaccaccatacccagctaatttttgtatttttagtagtgaaggggttttaccatgttgggcaggctggtcttgaactcctgacctcaggtgatctgcccgcctcagcctcccacagtgctgggattacaggtatgagccaccacgcccggcccattttttttttttttttgacaacttttttttttttttgagacagggtcttgttccattgcccagactggagtgcagtggcatgatcacagctcactgcagccagtaatcctcttgcctcagcctcccaagtagttgagactacaggttgtaccactatgccctgctagttttttcattttttgtagagagacgggtcttttttttttttgagacggagtctcgctctgtcgcccaagctggagtgcagtagcacggtctcagctcattgcaagctccgcctcccaggttcacgccattctcctgcctcagactcctgtgtagctgggagtacaggcacctgccaccatgcccggctaattttttatatatttttttagcagagacagtgtctcactgtgttagtcaggatggtctcgatctcctgacctcgtgatccgcccgcctcagcctcccaaagtgctgggattacaggcgtgagccaccgcgcccagcaaggcgggtcttgctgtgtttcccagactagactggtcttgaattccagggctcaagagatctcccacctcagcctcccacagtgctgggattacaggcgtgagccgccacacccagcctattcaaaatttttttttcttagagacagggtctttgttgcccaggctggactgcagtgatacaatcatagctgactgaagcctcaaattcccaggctaaggtgatcttctcacctcagccttccaagtagctgggtccgcagatgcatgccagtacacccagctcatttaaaaaaaaatttttttcttttttgagagtcttgctttgttgcccaggctggagtgcagtggtgtgatctcggctcactgcaagctccacctcccggcttcacgccattctcctgcctcagcctcccgagtagctgggactacaggtgcccgccaccacacccggctaattttttgtatttttagtagagacggggtttcaccgtgttagccaggatggtcttgatctcctgacctcatgatccgcctgctttggcctcccaaagtgctgggattacaggcgtgagtcaccgcgcccggctcattttaaaatttttgtagatcagtgtactgttgtaaaaaaaaaaaaa

SEQ ID NO: 137298 - DNA, 557 bp, Homo sapiens
  Payload ID: 6884
  Gene Symbol: GPI
  Gene Name: glucose-6-phosphate isomerase
  ENST ID: ENST00000587521
  CDS Start-End: 228-557
atccgcgcctgcgctcaaccccgcctacacctgctccgtggcctccccggaggcgatgagccaaccccggtagctccagaggcgtggtcccctcgccttcgccggtcaacatgactcagcatcctcgcgcctagaacactgcctgtaacgtggaaggtgttcgatctatagagttttgtcgaatgaatgaatgaagccgactagtgcacagggagtgcagcggcgcgatggtagctctctgcagcctccaacacctgggctccagtgatccccgggctctgcccaccctccccactgccacttccgggcagaggccagcaaagcggcggcgcaagagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttg

SEQ ID NO: 137299 - DNA, 678 bp, Homo sapiens
  Payload ID: 6884
  Gene Symbol: GPI
  Gene Name: glucose-6-phosphate isomerase
  ENST ID: ENST00000592144
  CDS Start-End: 1-32
agaggccagcaaagcggcggcgcaagaggtagggagagaggagctgaggccccagatcagcggccgcgggcaaggtcgctcagcgggcacccggcctggtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactca

SEQ ID NO: 137300 - DNA, 2021 bp, Homo sapiens
  Payload ID: 6884
  Gene Symbol: GPI
  Gene Name: glucose-6-phosphate isomerase
  ENST ID: ENST00000588991
  CDS Start-End: 1-1722
acttccgggcagaggccagcaaagcggcggcgcaagagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgta

SEQ ID NO: 137301 - DNA, 615 bp, Homo sapiens
  Payload ID: 6884
  Gene Symbol: GPI
  Gene Name: glucose-6-phosphate isomerase
  ENST ID: ENST00000592277
  CDS Start-End: 178-615
agtccctctgccttcactcccatggccacctgtgctccagggcctgcctgacccctgtccagcggccctgaagtaagcgcctagaacactgcctgtaacgtggaaggtgttcgatctatagagttttgtcgaatgaatgaatgaagccgactagtgcacagggagtgcagcggcgcgatggtagctctctgcagcctccaacacctgggctccagtgatccccgggctctgcccaccctccccactgccacttccgggcagaggccagcaaagcggcggcgcaagagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtca

SEQ ID NO: 137302 - DNA, 559 bp, Homo sapiens
  Payload ID: 6884
  Gene Symbol: GPI
  Gene Name: glucose-6-phosphate isomerase
  ENST ID: ENST00000591204
  CDS Start-End: 72-559
gcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtc

SEQ ID NO: 137303 - DNA, 529 bp, Homo sapiens
  Payload ID: 6884
  Gene Symbol: GPI
  Gene Name: glucose-6-phosphate isomerase
  ENST ID: ENST00000590375
  CDS Start-End: 52-529
agggagagaggagctgaggccccagatcagcggccgcgggcaagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggct

SEQ ID NO: 137304 - DNA, 571 bp, Homo sapiens
  Payload ID: 6884
  Gene Symbol: GPI
  Gene Name: glucose-6-phosphate isomerase
  ENST ID: ENST00000589640
  CDS Start-End: 72-571
gcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagggacccctcatggtgactgaagcccttaagccatactcttcaggaggtccccgcgtctggtatgtctccaacattgatggaactcacattgccaaaac

SEQ ID NO: 137305 - DNA, 1799 bp, Homo sapiens
  Payload ID: 6884
  Gene Symbol: GPI
  Gene Name: glucose-6-phosphate isomerase
  ENST ID: ENST00000586425
  CDS Start-End: 26-1450
actcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataagagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacc

SEQ ID NO: 137306 - DNA, 565 bp, Homo sapiens
  Payload ID: 6884
  Gene Symbol: GPI
  Gene Name: glucose-6-phosphate isomerase
  ENST ID: ENST00000589399
  CDS Start-End: 81-565
acgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgt

SEQ ID NO: 137307 - DNA, 810 bp, Homo sapiens
  Payload ID: 6884
  Gene Symbol: GPI
  Gene Name: glucose-6-phosphate isomerase
  ENST ID: ENST00000587384
  CDS Start-End: 411-810
aacatgactcagcatcctcggtgggctcgcctcctcccccggaacagctgtctaaaatccatgggcgtggaaacgccacgccacgccccgctcccgacttcttcagctcaggccccagaactgaccaccccaccagtcctctgccccagtccctctgccttcactcccatggccacctgtgctccagggcctgcctgacccctgtccagcggccctgaagtaaggtctgtgatgtctaaatgccgatacctcagtttccccatctttagaacggggctcttgtttggaactgtgcccgccacagcctgcacgcctagaacactgcctgtaacgtggaaggtgttcgatctatagagttttgtcgaatgaatgaatgaagccgactagtgcacagggagtgcagcggcgcgatggtagctctctgcagcctccaacacctgggctccagtgatccccgggctctgcccaccctccccactgccacttccgggcagaggccagcaaagcggcggcgcaagagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagg

SEQ ID NO: 137308 - DNA, 829 bp, Homo sapiens
  Payload ID: 6884
  Gene Symbol: GPI
  Gene Name: glucose-6-phosphate isomerase
  ENST ID: ENST00000633130
  CDS Start-End: 26-829
actcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctggggcccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggat

SEQ ID NO: 137309 - DNA, 559 bp, Homo sapiens
  Payload ID: 6884
  Gene Symbol: GPI
  Gene Name: glucose-6-phosphate isomerase
  ENST ID: ENST00000632543
  CDS Start-End: 72-559
gcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagcgtgtccggagcggtgactggaaggggtacacaggcaagaccatcacggacgtcatcaacattggcattggcggctccgacctggggcccctcatggtgactgaagcccttaagccatactcttcaggaggtccccgcgtctggtatgtctccaacattgatggaactcacattgccaaaaccctggcccagctgaaccccgagtc

SEQ ID NO: 137310 - DNA, 529 bp, Homo sapiens; identical to SEQ ID NO: 137303
  Payload ID: 6884
  Gene Symbol: GPI
  Gene Name: glucose-6-phosphate isomerase
  ENST ID: ENST00000632809
  CDS Start-End: 52-529

SEQ ID NO: 137311 - DNA, 571 bp, Homo sapiens
  Payload ID: 6884
  Gene Symbol: GPI
  Gene Name: glucose-6-phosphate isomerase
  ENST ID: ENST00000631729
  CDS Start-End: 72-571
gcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccaggggcccctcatggtgactgaagcccttaagccatactcttcaggaggtccccgcgtctggtatgtctccaacattgatggaactcacattgccaaaac

SEQ ID NO: 137312 - DNA, 1007 bp, Homo sapiens
  Payload ID: 6884
  Gene Symbol: GPI
  Gene Name: glucose-6-phosphate isomerase
  ENST ID: ENST00000633059
  CDS Start-End: 171-1007
aatagcccttaccaccagcagacacacatcatctgttgtacttgcttatttggcacatatgtatccacagcgcctagaacactgcctgtaacgtggaaggtgttcgatctatagagttttgtcgaatgaatgaatgaagccgactagtgcacagggagtgcagcggcgcgatggtagctctctgcagcctccaacacctgggctccagtgatccccgggctctgcccaccctccccactgccacttccgggcagaggccagcaaagcggcggcgcaagagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccaggggcccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggat

SEQ ID NO: 137313 - DNA, 809 bp, Homo sapiens
  Payload ID: 6884
  Gene Symbol: GPI
  Gene Name: glucose-6-phosphate isomerase
  ENST ID: ENST00000633375
  CDS Start-End: 411-809
aacatgactcagcatcctcggtgggctcgcctcctcccccggaacagctgtctaaaatccatgggcgtggaaacgccacgccacgccccgctcccgacttcttcagctcaggccccagaactgaccaccccaccagtcctctgccccagtccctctgccttcactcccatggccacctgtgctccagggcctgcctgacccctgtccagcggccctgaagtaaggtctgtgatgtctaaatgccgatacctcagtttccccatctttagaacggggctcttgtttggaactgtgcccgccacagcctgcacgcctagaacactgcctgtaacgtggaaggtgttcgatctatagagttttgtcgaatgaatgaatgaagccgactagtgcacagggagtgcagcggcgcgatggtagctctctgcagcctccaacacctgggctccagtgatccccgggctctgcccaccctccccactgccacttccgggcagaggccagcaaagcggcggcgcaagagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgag

SEQ ID NO: 137314 - DNA, 565 bp, Homo sapiens
  Payload ID: 6884
  Gene Symbol: GPI
  Gene Name: glucose-6-phosphate isomerase
  ENST ID: ENST00000633941
  CDS Start-End: 81-565
acgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgaggatgtgatgccagaggtcaacaaggttctggacaagatgaagtctttctgccagcgtgtccggagcggtgactggaaggggtacacaggcaagaccatcacggacgtcatcaacattggcattggcggctccgacctggggcccctcatggtgactgaagcccttaagccatactcttcaggaggtccccgcgtctggtatgt

SEQ ID NO: 137315 - DNA, 1045 bp, Homo sapiens
  Payload ID: 6884
  Gene Symbol: GPI
  Gene Name: glucose-6-phosphate isomerase
  ENST ID: ENST00000632407
  CDS Start-End: 242-1045
agagaggagctgaggccccagatcagcggccgcgggcaaggtcgctcagcgggcacccggcctgggtatcggggcgcgggtcgggggcggggccggggctcaggggtggggccgggccgggccgggccgggcgcctgcgccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctggggcccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggat

SEQ ID NO: 137316 - DNA, 678 bp, Homo sapiens
  Payload ID: 6884
  Gene Symbol: GPI
  Gene Name: glucose-6-phosphate isomerase
  ENST ID: ENST00000631851
  CDS Start-End: 1-32
agaggccagcaaagcggcggcgcaagaggtagggagagaggagctgaggccccagatcagcggccgcgggcaaggtcgctcagcgggcacccggcctggtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctggggcccctcatggtgactgaagcccttaagccatactcttcaggaggtccccgcgtctggtatgtctccaacattgatggaactca

SEQ ID NO: 137317 - DNA, 615 bp, Homo sapiens; identical to SEQ ID NO: 137301
  Payload ID: 6884
  Gene Symbol: GPI
  Gene Name: glucose-6-phosphate isomerase
  ENST ID: ENST00000634112
  CDS Start-End: 178-615

SEQ ID NO: 137318 - DNA, 849 bp, Homo sapiens
  Payload ID: 6884
  Gene Symbol: GPI
  Gene Name: glucose-6-phosphate isomerase
  ENST ID: ENST00000632704
  CDS Start-End: 1-849
acttccgggcagaggccagcaaagcggcggcgcaagagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctggggcccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggat

SEQ ID NO: 137319 - DNA, 557 bp, Homo sapiens; identical to SEQ ID NO: 137298
  Payload ID: 6884
  Gene Symbol: GPI
  Gene Name: glucose-6-phosphate isomerase
  ENST ID: ENST00000633181
  CDS Start-End: 228-557

SEQ ID NO: 137320 - DNA, 2604 bp, Homo sapiens
  Payload ID: 6885
  Gene Symbol:
  Gene Name: Glucose-6-phosphate translocase  [Source:UniProtKB/Swiss-Prot
  Acc:O43826]
  Uniprot ID: O43826
  ENST ID: ENST00000631372
  CDS Start-End: 758-2047
gcttgcgcagccttcgctagccccgccccgtcctattcgggctcccgcctctgttcagttccagagacaattcatgggtcttggggccaccgaggcgctgtccctgaccaccagcacgagacccctttctatcgcgccagtcctgtggtctccgcacctctccagctcctgcacccccggcccccgtggttcccagccgcacagtagcgtgtcctgggtagcgtgaggacccacggggctgggcaggtgccacgagcccgccgcctcttcgccgcccgccgcctctcctcctctcccgcccgccgcctggccctcccctaccaggctgagcctctgggtgccagaagcgcggggcctccgggagaatacgtgcggtcgcccgctccgcgtgcgcctacgccttctgctccagttgctttcccaattgagcggaaaagccggggcatgttgccggggccctgggcgggacggttgtgccctgcagcccgaagcccgccggggcaccttcccgcccacgagctgcccagtccctctgcttgcggcccctgccaacgtcccacaggacactgggtccccttggagcctccccaggcttaatgattgtccagaaggcggctataaagggagcctgggaggctgggtggaggagggagcagaaaaaacccaactcagcagatctgggaactgtgagagcggcaagcaggaactgtggtcagaggctgtgcgtcttggctggtagggcctgctcttttctaccatggcagcccagggctatggctattatcgcactgtgatcttctcagccatgtttgggggctacagcctgtattacttcaatcgcaagaccttctcctttgtcatgccatcattggtggaagagatccctttggacaaggatgatttggggttcatcaccagcagccagtcggcagcttatgctatcagcaagtttgtcagtggggtgctgtctgaccagatgagtgctcgctggctcttctcttctgggctgctcctggttggcctggtcaacatattctttgcctggagctccacagtacctgtctttgctgccctctggttccttaatggcctggcccaggggctgggctggcccccatgtgggaaggtcctgcggaagtggtttgagccatctcagtttggcacttggtgggccatcctgtcaaccagcatgaacctggctggagggctgggccctatcctggcaaccatccttgcccagagctacagctggcgcagcacgctggccctatctggggcactgtgtgtggttgtctccttcctctgtctcctgctcatccacaatgaacctgctgatgttggactccgcaacctggaccccatgccctctgagggcaagaagggctccttgaaggaggagagcaccctgcaggagctgctgctgtccccttacctgtgggtgctctccactggttaccttgtggtgtttggagtaaagacctgctgtactgactggggccagttcttccttatccaggagaaaggacagtcagcccttgtaggtagctcctacatgagtgccctggaagttgggggccttgtaggcagcatcgcagctggctacctgtcagaccgggccatggcaaaggcgggactgtccaactacgggaaccctcgccatggcctgttgctgttcatgatggctggcatgacagtgtccatgtacctcttccgggtaacagtgaccagtgactcccccaagctctggatcctggtattgggagctgtatttggtttctcctcgtatggccccattgccctgtttggagtcatagccaacgagagtgcccctcccaacttgtgtggcacctcccacgccattgtgggactcatggccaatgtgggcggctttctggctgggctgcccttcagcaccattgccaagcactacagttggagcacagccttctgggtggctgaagtgatttgtgcggccagcacggctgccttcttcctcctacgaaacatccgcaccaagatgggccgagtgtccaagaaggctgagtgaagagagtccaggttccggagcaccatcccacggtggccttccccctgcacgctctgcggggagaaaaggaggggcctgcctggctagccctgaacctttcactttccatttctgcgccttttctgtcacccgggtggcgctggaagttatcagtggctagtgaggtcccagctccctgatcctatgctctatttaaaagataacctttggccttagactccgttagctcctatttcctgccttcagacaaacaggaaacttctgcagtcaggaaggctcctgtacccttcttcttttcctaggccctgtcctgcccgcatcctaccccatccccacctgaagtgaggctatccctgcagctgcagggcactaatgacccttgacttctgctgggtcctaagtcctctcagcagtgggtgactgctgttgccaatacctcagactccagggaaagagaggaggccatcattctcactgtaccactaggcgcagttggatataggtgggaagaaaaggtgacttgttatagaagattaaaactagatttgatactgaac

SEQ ID NO: 137321 - DNA, 8061 bp, Homo sapiens
  Payload ID: 6886
  Gene Symbol: GFOD1
  Gene Name: glucose-fructose oxidoreductase domain containing 1
  Uniprot ID: Q9NXC2
  ENST ID: ENST00000379284
  CDS Start-End: 285-1148
acttcataaagactctatgtggaggatagatgctaccgtggccgggctctcagccacgttcttctgcagtatgcagtagggaagggcacatttctcacatgccttcaccagattatagttttctgggagcaaagccaagtgctcccacctttgggtgctgacccaagaagagatattctgtgaacttctgctctttggttgggcaatctccgagagtcagttggttgggcatcggcaagaacgtcatctgcgaccgcacggccacgccgctggacgctttccgcatgacctcggccgcccactactaccccaagctcatgagcatcatgggcaacgtgctgcgcttcctgccggctttcgtgcgcatgaagcagctgatcgaggagggctacgtgggcgagccgctggtgtgtgaggtgcaggtgcacggcggcagcctgctgggcaagaagtacaactggagctgcgacgacttgatgggcggcggcggcctgcactccgtgggcacctacatcatcgacctgctcaccttcctcaccggccaaaaggccgtcaaggtccacgggctgctcaagaccttcgtgaagcagactgaccacatcaagggcatccgacagatcaccagcgatgacttctgcaccttccagatggtgctggagggcggggtgtgctgcaccgtcaccctcaacttcaacgtgcccggcgagttcaagcaggatgtcactgtggtgggctcagccgggcgcctgctggccgtgggcaccgacctgtacgggcagcgcaacagcgccccggagcaggagctgctggtgcaggacgccacgccggtgagcaactccctgcttccggagaaggccttcagcgacatcccctcgccctacctgcgcggcaccatcaagatgatgcaggcggtgcgccaggccttccaggaccaggacgaccggcgcacgtgggatgggcggcccctcaccatggccgccaccttcgacgactgcctgtatgccttgtgcgtggtggacaccatcaagaggtccagccagacgggcgagtggcagaacattgccatcatgaccgaggagccggagctgagccccgcctacctgatcagcgaggccatgcgccgcagcaggatgtccctctactgttagcacagattgagaacctcggggacttgagccttctgcaggggatgtccacagagagggaagggccgaggggagagggtgaccatggggaatgtggggatcagggaggtggagggacagtgtgaataaatggcatctaggaaggtaaactccaatcccggtgaccgaccccaaaccagactgttggtgggctgagctcctagcctggaagcattcaggagagcctgccattcctgggatgatccctgctgggtatttgcacgagagtggtttggtttagctgcctctgctgccctttactgtgacaagcaaggaggggttgcttccctccctacctcatccatcccacacaccttggccttctgcaagccaagtggttctgcaaggtcaaggcactagtatcagatggcaagctcagtgcccgggatacccactgctggcaggagaaggcccattttcacagtccacagaagcgtgttaggctggggttgggggtgggatgggctggtgagaaagttcaaattccaggaagccactttttattggatataaggtatctaacggcaaaagtacttagtagcaaagtggccaccttttgattgattgggcttcctcataggaagcactgagggtgtgtctttgtacttggttcattgcccttcacctggtagagaaagagaggtcagaaatagcaagcaaaaagcaggactcccaggagccacaagaaaagagcacaggctgcaccaaagcaggggcagcagagaataaaatatccctttgaacttgtcaacaattaaaaaactgcaaggagtcaccttataacactatttccagtaaaggtggaattgagtatcagagggattactgcggtgttaaggtagccctgccacgtggctctccaggcagggccaagaagacagcacaaagtatgggtttggccataagctcatatgctgcccccaaagactggggagagctgtgtgcctcagtgttgcagtgtgaattcctaaatagagggtaaagtgagcctagccaggaggtgtttggggctctatcgcgcatctctcctaccaagctgggcaagagcttttaggagattcatccagctttgtggatttagaaaggaagccttcagttccaatcagaatcctctttccttacaaaaaaaaaaaaaaaaaaaaaaaaaaaaaggattttccttagctccagcatttgctttcaggattctgacacctgagaatttgggggtaggtactaaacgaaacaaaacaaaaggacaacaaggaacattatttctagtgtttctaaaatgggggtttagaaccccttaaggggccatacttaggcttgaaaaggctaatgttggaaaaaacatgttcttctaattggtctgctgtctgtcttgtccttgcacactctgcttacagagttttgttagagatgctgaactgcaggctgggagcaggcagtgccaaaagggaacagacacacacacacatgcacgtgcacacacacacacacacacacacacacagatttttgaatggttgctaccgacaaatgtcgctgaaaccattctttaaaaattcagatctggtcttgaaagaaagagccaatcaagtgcattcagagaacagggaattatcctttgttatctttgtttaattcttcaccccacgtaagacatttgtcaagtgtggacgtggaagccattcctcataagtctacgtagcttttgttcacaggctcactgaagtccaacaggtgtctttacatgcaactgaggtttagagttcttttcagatagctgccattggaactagaagggaatctaagaggactggagtccacctccagcctgtgtaggcaaaatctgagaatgaacagcccaatcagttgcatccttcattgtcctccctagggtcaatattctttgaagcccaggctactcataggtgcaagtgtggtgtgtccaaacacgaggggaatgctgggcattttctagaacagagaagtaagtactgccttcctggaaagagtcgccctgcttcccgaggctttgctacagcactgcagggtgggtaagctgaaattccatgcgtggtttgttgtggtccctgacctgttgctgacagacttcatggtcagcattccagctcttgcagctatcagttccaaaccagagatttgctggaatggaagtctcccaataatagtttgaacagaggcccatgtcatggactgctttggttcacattcttcttctttttttttttttttttttgaaatggagtctcgctctgtcacccaagctggagtgcagtggtgtgatctcagctcactgcaacctctgcctcccaggttcaagcgattctcctgtctcagcctcccgagcagcagggactacgggtggctgccaccacagccggctaattttttgtatttttagtagagacggggtttcactgtattagccagcatggtctcgatctcctgacctcttgatccacctgccttggccttgcaaagtgctggggttgcaggcgtgagccaccacacccagctgattctggttcttctaaattgctccctgggaaagtagtttttggggaaacattggaattattattattattattttctagctagcctgaagggctccgattaaggatgaagggaaagtaaacaaaatgattcaatgggtttcatttttctaagtcattcataacctaaatagggatattcctggggtttcaattgtatgtttctgtactaaaccataatactcgcgaaatcttttcccaaaacttcgggttttggagagaggtccccacaaaggcctctaagctctgtaatacatatttaatgtctaaaacaaaaaatctcatttgaagctggggtattagaaagaacatatattctttaaaagaggcatgaaaaaatattttagtgtgtgtactcaaattttatctactgaaatgcatgtagtaggtaggtgaaggaacaagagaaagaaaagaactggatagttcattttctttaaatataaactgtagcaaatgggtttgagatactcctttagtgctccatttgcccttatcccaccacatgcaaagacttgatttggggtagctatatgaagctgaaatctctagccttcaacagtgttctgcagaaggactttgtttcagcccagcaccgttcatcatgcctttaggggtctgggtacccacagctgactttgacctaggactaaaacccagcaatcttttggctcctttctgctttgtttaatgtgtttcaagggcctcgatgcaaggaggcagtgctttaagagtcttcccatttagttcctgcatgcctgtttcgttcccatcaatgtgcgaatggcctagattccaagttatgagggagggtgtgggtcagggttcttacctggtatttaaaaaatgtttgggagtgccctgggcctatttgaaaagtttgaatctgtgatcactgtcagctcctccaagacttctcctctcaacagacaattgcattgtagggcaccccagaccccccttagcctacatggcagcaaataccactgtgccagttatatctggactctagggtagtcttggccaactccaagactggccaactccaagacttgtccactgtgtgcagagtattttaagtatgttatctcatacaatccataaaaacaaccctatagtgttgggtattgctatttcttttatacacatgagaaaatggaggcagtaagaggaagaggaacttgttcaaagtcacacaactgttaggcagaaatgaggtcattcaaatccttaatcttctcctccagaccacactgcctcccaggaagagatgtgggcacctcctgttcttgccaggcaggaaaccgctccttatcaatgtctacggggtctgctctcacacccaggaaggactgtgacaagcatggactaacctgcggctccactcagcctgctgtcagcaccctcctgttcagcaggatgcaacatctgatgttctgccaggaggctgtagagctgcacatagaagtagccagtgtttcttcccattccaaaatggaaatatcactcagccttttttaaaattgacttcctatgttcattttgattgtaggtgatgcagcaagcctcagggctggggattttcaaaatcttgttggctgactattatagatggccttggaatttgctcttgggggtctgaatataacgtaggaaaatgtcctttctcagggagtggggctttaaagttcgtttgtttgtcactccaattttagctgtgcactgcacctttctttgcacccctactctcttcatcttgtctcatagccacagctattgaatttggcctgtgatcataagttgggtttctgatctgatctcttgcattctggtgggtactgggggcagaatcagctttgttaatgattttctgggcagaaggtaaattcagctgcatctgaaggggcttcacagtccaatagccgtccttttgttttacataacagagagtgatggtcaaggccacccacatctttagtggtagagccaggacaaaaagtcaggttttctgcctcttaagtctcatgctgcctcacatagcacctccagagctctagggaaaggaggctcagagagatgaagtgacttgtctgaagtcctgtggctagtggcagagaagttggaattagacctgcattggacctcaattcgctgagcagttgcagggaaatctggaaatccttttttttttttttttgagacagagtcttactctgtcacccaggctggagtgcaatggcgtgatctcagctcactgcaacaccgcctcccgggttcaagcgattctcctgcctcagcctcctgagtagctgggattacagacgcacgccaccatgcccggctaatttttgtatttttagtagagacaaggtttccccatattggtcaggctggtcttgaactcctgaccttgtgatccgcccgccttgacctcccaaagtgctgggatgacaggcgtgatccaccgtgcccagccgggaaatccattttttaaaataaattcaattatgtcttgaatgtactcagaaaacgagctgtttaaaatgtcccattgtgactgtaatgtgaacaatgacctctaacttgtattttatttggcaaggatgggggatgtgcatcaaatcttcacctctgggatttcctgaggcttggtctacttggctcaccctccacctgcatccccaccccactcctagatattaatacaaatctagccttgacaccgcctactgctccaccaccgcctacgtttttggccatcagagccttggagtttacagagcagaggccatgacattggggagcttgtttaaaaatcaatgatcagaaccccacattttagtttccttttggggagaaagaggagggccgtggaagaaaaggggtgtgcagctggagcgttattatgtctttctcagcggcaggcatgcccgcctctccaccttctccccgccaggcacaggagccagcagctggagcgtgctctgagtttcaggggaccccccacccagactgactggggcttctgggacttctcataggaagagtcaagacctcctgcgcttctttaaaaggtgatgggctcagtgttcccagtggcatctggaggtgaagccggtactgtctcaggagtggaaggcaatggcccactggcctttttctcccccacgtcacagtccccatttgctggagcccttgagggggccaccgaaactgtggctctcattcagcctcccaaagtgttgcactactgaatactcctttctgtttacaccagcagtgaatagagtcatgaaaagaacatattatatgcaatggcttgatgcttagtgtggcaatcaaaagcttgcctgggcagatgtaggcaggggctagacaatagtcatggagttgtcaccaggtcactgtctctctccttccccttccaggtctctactgtcccctgcagccaccacaagggctaagctgttgaatgagccccttggtttttccttataaacgcaatgacttacttgtgattcttggtctaatcccaggctaagaaacaaaacaaaagcttgtgatctgacccattcctttgctgccttccttctctttcaggcacctggacgtatttagtattctgccctgtgccttgcccaggggagggagaagtttctagcaaatgtgactttctgtctgctgcctggtgcttttatagtacttcatctgctttttattgttgttgttgtgttttttaaccaaaatggcatttgtttggctgtcattgtcgagtatatatttattgtgttttacaaacatgagtatatatgtatgtatatgtataaaaccaaacttatatatataagaagtcaaggcatgtatactagatattttaaagagttatttatcaagggaaaaagatgtgtgttataaagtaaacagagtctatattttctatataatgtagatagtcaaacatagcttataaattataggaggttttggttttcttttttattattaaaggaaaaaaagaagaaaaaaaaagacaatgaatgcaactgttcttagtgtttttaaggccaaactactgtggaagctgggaggcggccctccctgcgggcctccagcagccctgtgcctgccgctaggagctccagagctgatgcccgttgtgatctctgcgatgctcgatgctcggagccagcggtcagcatcactcagccagctggcctgtgccgctctgacgtggcttccagctgttctccgcaatttgcattggtgggataaaggaatgaaaaggataaataaagatttaaaagaaaatacaa

SEQ ID NO: 137322 - DNA, 8751 bp, Homo sapiens
  Payload ID: 6886
  Gene Symbol: GFOD1
  Gene Name: glucose-fructose oxidoreductase domain containing 1
  Uniprot ID: Q9NXC2
  ENST ID: ENST00000379287
  CDS Start-End: 666-1838
gagcgaacatggcagcagaatgaggaggctggcgccgggtcgtggccgccgctgccgcgctgcagctcgggatcccagtccggcgcgctccgggccgcatccttagccggcctcctggcggccgcgggattatttcattcccaacggagagctaggaagaaaggagactcccccgcggagcggttccgtgctctggcagggtgtagacgtttgtctgtgcgattcgccggctgcgcaaacgacgcgggagagagccggtcccgggctgcggcggcgcggccgcggggatgagccggccatggagcggccttggcggggcgcacgcagcggactggcgctgccgcgggagcgcagcctgagccggggctccagggggcttcgaagcctccggcgccctgggggggtccctgccgccgactccgggaaggacgcgagccccgcgtggcggacactgccgcagtcaccgttctgaggcgccccgagcttgctccgcctgcagctcggtgcgctctgggcacccgggcgccttgcccggtgcacggcggctggcgcaccgcggctagattggctacaggagcggggtgcaggactggctagaggtgggtgtgtgcgcgcgttggactggagatccgagcagaagcagaaccaggcggctctgagcagccatgcttcccggggtgggcgtgttcggcaccagcctcacggcccgtgtcatcatcccgctgctgaaagacgagggcttcgcggtgaaggcgctgtggggccgcacgcaggaagaagcggaggagctggccaaggagatgagtgtccccttctacactagccgcattgatgaggtgctgctgcatcaggacgtggacttggtgtgcattaacctgccgccgcccctcaccagacagatcgctgtcaaaaccctaggcatcggcaagaacgtcatctgcgaccgcacggccacgccgctggacgctttccgcatgacctcggccgcccactactaccccaagctcatgagcatcatgggcaacgtgctgcgcttcctgccggctttcgtgcgcatgaagcagctgatcgaggagggctacgtgggcgagccgctggtgtgtgaggtgcaggtgcacggcggcagcctgctgggcaagaagtacaactggagctgcgacgacttgatgggcggcggcggcctgcactccgtgggcacctacatcatcgacctgctcaccttcctcaccggccaaaaggccgtcaaggtccacgggctgctcaagaccttcgtgaagcagactgaccacatcaagggcatccgacagatcaccagcgatgacttctgcaccttccagatggtgctggagggcggggtgtgctgcaccgtcaccctcaacttcaacgtgcccggcgagttcaagcaggatgtcactgtggtgggctcagccgggcgcctgctggccgtgggcaccgacctgtacgggcagcgcaacagcgccccggagcaggagctgctggtgcaggacgccacgccggtgagcaactccctgcttccggagaaggccttcagcgacatcccctcgccctacctgcgcggcaccatcaagatgatgcaggcggtgcgccaggccttccaggaccaggacgaccggcgcacgtgggatgggcggcccctcaccatggccgccaccttcgacgactgcctgtatgccttgtgcgtggtggacaccatcaagaggtccagccagacgggcgagtggcagaacattgccatcatgaccgaggagccggagctgagccccgcctacctgatcagcgaggccatgcgccgcagcaggatgtccctctactgttagcacagattgagaacctcggggacttgagccttctgcaggggatgtccacagagagggaagggccgaggggagagggtgaccatggggaatgtggggatcagggaggtggagggacagtgtgaataaatggcatctaggaaggtaaactccaatcccggtgaccgaccccaaaccagactgttggtgggctgagctcctagcctggaagcattcaggagagcctgccattcctgggatgatccctgctgggtatttgcacgagagtggtttggtttagctgcctctgctgccctttactgtgacaagcaaggaggggttgcttccctccctacctcatccatcccacacaccttggccttctgcaagccaagtggttctgcaaggtcaaggcactagtatcagatggcaagctcagtgcccgggatacccactgctggcaggagaaggcccattttcacagtccacagaagcgtgttaggctggggttgggggtgggatgggctggtgagaaagttcaaattccaggaagccactttttattggatataaggtatctaacggcaaaagtacttagtagcaaagtggccaccttttgattgattgggcttcctcataggaagcactgagggtgtgtctttgtacttggttcattgcccttcacctggtagagaaagagaggtcagaaatagcaagcaaaaagcaggactcccaggagccacaagaaaagagcacaggctgcaccaaagcaggggcagcagagaataaaatatccctttgaacttgtcaacaattaaaaaactgcaaggagtcaccttataacactatttccagtaaaggtggaattgagtatcagagggattactgcggtgttaaggtagccctgccacgtggctctccaggcagggccaagaagacagcacaaagtatgggtttggccataagctcatatgctgcccccaaagactggggagagctgtgtgcctcagtgttgcagtgtgaattcctaaatagagggtaaagtgagcctagccaggaggtgtttggggctctatcgcgcatctctcctaccaagctgggcaagagcttttaggagattcatccagctttgtggatttagaaaggaagccttcagttccaatcagaatcctctttccttacaaaaaaaaaaaaaaaaaaaaaaaaaaaaaggattttccttagctccagcatttgctttcaggattctgacacctgagaatttgggggtaggtactaaacgaaacaaaacaaaaggacaacaaggaacattatttctagtgtttctaaaatgggggtttagaaccccttaaggggccatacttaggcttgaaaaggctaatgttggaaaaaacatgttcttctaattggtctgctgtctgtcttgtccttgcacactctgcttacagagttttgttagagatgctgaactgcaggctgggagcaggcagtgccaaaagggaacagacacacacacacatgcacgtgcacacacacacacacacacacacacacagatttttgaatggttgctaccgacaaatgtcgctgaaaccattctttaaaaattcagatctggtcttgaaagaaagagccaatcaagtgcattcagagaacagggaattatcctttgttatctttgtttaattcttcaccccacgtaagacatttgtcaagtgtggacgtggaagccattcctcataagtctacgtagcttttgttcacaggctcactgaagtccaacaggtgtctttacatgcaactgaggtttagagttcttttcagatagctgccattggaactagaagggaatctaagaggactggagtccacctccagcctgtgtaggcaaaatctgagaatgaacagcccaatcagttgcatccttcattgtcctccctagggtcaatattctttgaagcccaggctactcataggtgcaagtgtggtgtgtccaaacacgaggggaatgctgggcattttctagaacagagaagtaagtactgccttcctggaaagagtcgccctgcttcccgaggctttgctacagcactgcagggtgggtaagctgaaattccatgcgtggtttgttgtggtccctgacctgttgctgacagacttcatggtcagcattccagctcttgcagctatcagttccaaaccagagatttgctggaatggaagtctcccaataatagtttgaacagaggcccatgtcatggactgctttggttcacattcttcttctttttttttttttttttttgaaatggagtctcgctctgtcacccaagctggagtgcagtggtgtgatctcagctcactgcaacctctgcctcccaggttcaagcgattctcctgtctcagcctcccgagcagcagggactacgggtggctgccaccacagccggctaattttttgtatttttagtagagacggggtttcactgtattagccagcatggtctcgatctcctgacctcttgatccacctgccttggccttgcaaagtgctggggttgcaggcgtgagccaccacacccagctgattctggttcttctaaattgctccctgggaaagtagtttttggggaaacattggaattattattattattattttctagctagcctgaagggctccgattaaggatgaagggaaagtaaacaaaatgattcaatgggtttcatttttctaagtcattcataacctaaatagggatattcctggggtttcaattgtatgtttctgtactaaaccataatactcgcgaaatcttttcccaaaacttcgggttttggagagaggtccccacaaaggcctctaagctctgtaatacatatttaatgtctaaaacaaaaaatctcatttgaagctggggtattagaaagaacatatattctttaaaagaggcatgaaaaaatattttagtgtgtgtactcaaattttatctactgaaatgcatgtagtaggtaggtgaaggaacaagagaaagaaaagaactggatagttcattttctttaaatataaactgtagcaaatgggtttgagatactcctttagtgctccatttgcccttatcccaccacatgcaaagacttgatttggggtagctatatgaagctgaaatctctagccttcaacagtgttctgcagaaggactttgtttcagcccagcaccgttcatcatgcctttaggggtctgggtacccacagctgactttgacctaggactaaaacccagcaatcttttggctcctttctgctttgtttaatgtgtttcaagggcctcgatgcaaggaggcagtgctttaagagtcttcccatttagttcctgcatgcctgtttcgttcccatcaatgtgcgaatggcctagattccaagttatgagggagggtgtgggtcagggttcttacctggtatttaaaaaatgtttgggagtgccctgggcctatttgaaaagtttgaatctgtgatcactgtcagctcctccaagacttctcctctcaacagacaattgcattgtagggcaccccagaccccccttagcctacatggcagcaaataccactgtgccagttatatctggactctagggtagtcttggccaactccaagactggccaactccaagacttgtccactgtgtgcagagtattttaagtatgttatctcatacaatccataaaaacaaccctatagtgttgggtattgctatttcttttatacacatgagaaaatggaggcagtaagaggaagaggaacttgttcaaagtcacacaactgttaggcagaaatgaggtcattcaaatccttaatcttctcctccagaccacactgcctcccaggaagagatgtgggcacctcctgttcttgccaggcaggaaaccgctccttatcaatgtctacggggtctgctctcacacccaggaaggactgtgacaagcatggactaacctgcggctccactcagcctgctgtcagcaccctcctgttcagcaggatgcaacatctgatgttctgccaggaggctgtagagctgcacatagaagtagccagtgtttcttcccattccaaaatggaaatatcactcagccttttttaaaattgacttcctatgttcattttgattgtaggtgatgcagcaagcctcagggctggggattttcaaaatcttgttggctgactattatagatggccttggaatttgctcttgggggtctgaatataacgtaggaaaatgtcctttctcagggagtggggctttaaagttcgtttgtttgtcactccaattttagctgtgcactgcacctttctttgcacccctactctcttcatcttgtctcatagccacagctattgaatttggcctgtgatcataagttgggtttctgatctgatctcttgcattctggtgggtactgggggcagaatcagctttgttaatgattttctgggcagaaggtaaattcagctgcatctgaaggggcttcacagtccaatagccgtccttttgttttacataacagagagtgatggtcaaggccacccacatctttagtggtagagccaggacaaaaagtcaggttttctgcctcttaagtctcatgctgcctcacatagcacctccagagctctagggaaaggaggctcagagagatgaagtgacttgtctgaagtcctgtggctagtggcagagaagttggaattagacctgcattggacctcaattcgctgagcagttgcagggaaatctggaaatccttttttttttttttttgagacagagtcttactctgtcacccaggctggagtgcaatggcgtgatctcagctcactgcaacaccgcctcccgggttcaagcgattctcctgcctcagcctcctgagtagctgggattacagacgcacgccaccatgcccggctaatttttgtatttttagtagagacaaggtttccccatattggtcaggctggtcttgaactcctgaccttgtgatccgcccgccttgacctcccaaagtgctgggatgacaggcgtgatccaccgtgcccagccgggaaatccattttttaaaataaattcaattatgtcttgaatgtactcagaaaacgagctgtttaaaatgtcccattgtgactgtaatgtgaacaatgacctctaacttgtattttatttggcaaggatgggggatgtgcatcaaatcttcacctctgggatttcctgaggcttggtctacttggctcaccctccacctgcatccccaccccactcctagatattaatacaaatctagccttgacaccgcctactgctccaccaccgcctacgtttttggccatcagagccttggagtttacagagcagaggccatgacattggggagcttgtttaaaaatcaatgatcagaaccccacattttagtttccttttggggagaaagaggagggccgtggaagaaaaggggtgtgcagctggagcgttattatgtctttctcagcggcaggcatgcccgcctctccaccttctccccgccaggcacaggagccagcagctggagcgtgctctgagtttcaggggaccccccacccagactgactggggcttctgggacttctcataggaagagtcaagacctcctgcgcttctttaaaaggtgatgggctcagtgttcccagtggcatctggaggtgaagccggtactgtctcaggagtggaaggcaatggcccactggcctttttctcccccacgtcacagtccccatttgctggagcccttgagggggccaccgaaactgtggctctcattcagcctcccaaagtgttgcactactgaatactcctttctgtttacaccagcagtgaatagagtcatgaaaagaacatattatatgcaatggcttgatgcttagtgtggcaatcaaaagcttgcctgggcagatgtaggcaggggctagacaatagtcatggagttgtcaccaggtcactgtctctctccttccccttccaggtctctactgtcccctgcagccaccacaagggctaagctgttgaatgagccccttggtttttccttataaacgcaatgacttacttgtgattcttggtctaatcccaggctaagaaacaaaacaaaagcttgtgatctgacccattcctttgctgccttccttctctttcaggcacctggacgtatttagtattctgccctgtgccttgcccaggggagggagaagtttctagcaaatgtgactttctgtctgctgcctggtgcttttatagtacttcatctgctttttattgttgttgttgtgttttttaaccaaaatggcatttgtttggctgtcattgtcgagtatatatttattgtgttttacaaacatgagtatatatgtatgtatatgtataaaaccaaacttatatatataagaagtcaaggcatgtatactagatattttaaagagttatttatcaagggaaaaagatgtgtgttataaagtaaacagagtctatattttctatataatgtagatagtcaaacatagcttataaattataggaggttttggttttcttttttattattaaaggaaaaaaagaagaaaaaaaaagacaatgaatgcaactgttcttagtgtttttaaggccaaactactgtggaagctgggaggcggccctccctgcgggcctccagcagccctgtgcctgccgctaggagctccagagctgatgcccgttgtgatctctgcgatgctcgatgctcggagccagcggtcagcatcactcagccagctggcctgtgccgctctgacgtggcttccagctgttctccgcaatttgcattggtgggataaaggaatgaaaaggataaataaagatttaaaagaaaatacaa

SEQ ID NO: 137323 - DNA, 2388 bp, Homo sapiens
  Payload ID: 6886
  Gene Symbol: GFOD1
  Gene Name: glucose-fructose oxidoreductase domain containing 1
  ENST ID: ENST00000603223
  CDS Start-End: 773-1219
gcaggaacaccggccgctgacagccaaactcgccaactccgccctcgtccccgcgggatcccagagcctgagccggcctggggccgaggccgcccgagccgcgaggcgagcgaacatggcagcagaatgaggaggctggcgccgggtcgtggccgccgctgccgcgctgcagctcgggatcccagtccggcgcgctccgggccgcatccttagccggcctcctggcggccgcgggattatttcattcccaacggagagctaggaagaaaggagactcccccgcggagcggttccgtgctctggcagggtgtagacgtttgtctgtgcgattcgccggctgcgcaaacgacgcgggagagagccggtcccgggctgcggcggcgcggccgcggggatgagccggccatggagcggccttggcggggcgcacgcagcggactggcgctgccgcgggagcgcagcctgagccggggctccagggggcttcgaagcctccggcgccctgggggggtccctgccgccgactccgggaaggacgcgagccccgcgtggcggacactgccgcagtcaccgttctgaggcgccccgagcttgctccgcctgcagctcggtgcgctctgggcacccgggcgccttgcccggtgcacggcggctggcgcaccgcggctagattggctacaggagcggggtgcaggactggctagaggtgggtgtgtgcgcgcgttggactggagatccgagcagaagcagaaccaggcggctctgagcagccatgcttcccggggtgggcgtgttcggcaccagcctcacggcccgtgtcatcatcccgctgctgaaagacgagggcttcgcggtgaaggcgctgtggggccgcacgcaggaagaagcggaggagctggccaaggagatgagtgtccccttctacactagccgcattgatgaggtgctgctgcatcaggacgtggacttggtgtgcattaacctgccgccgcccctcaccagacagatcgctgtcaaaaccctagaaccaggacatcagaggaagaaaatcagcagacagaaaaatactggggaaaaaaaaatgccacgtggttctgttcagctgagcttctgctccctccagcacccccacatgggacatttgtttaccccccacgatgctgctcttggagagtcccaggggacaggtttcaagcccttagggatgcagcctgtctaacttaatatgcacagccgttcacatccagggcacagaggcagcctggctttccctggaggcccacggggaccacaatgctgcatttgtctgtggaactgagatttagctgcacattcttgcctgaatgcagcgggcctccagccacagcctgctggcatgggggattccaggagggatgtgcttcatgagccggcaattgcccttctttccagtccccagacccagtcaagattacagatagatgcgttcatcgcgcgcaggtgctggggaagccagtgggacatcactggctacattcaccaacaggattttccaactgcagtatttatcggtttttcaaacgaattcaacatctgtattcctcacccatttactgagtggctacaatgtgtaaggaaatattctcagtcatggggagttagaaaaggtcaaaggcatataagatatggcatgtgctctgagagaactcatcatctatccagaacctactcatcacttttggaaagagaagagaaactagcattctatggagtacttaccatgtgccagatttggtgtgagacatagtacgagtgttactcatttacgtctcatggccaacctccaatgtggacatttagcatctccatcttacaagtgagaaatttcactgtagagaggttaaatatcatgtgtcattgattctgtgacatgtattattttcacatttgaacatctgaaatatagatatgtctaaaagggcttttctttcttggtagtaagataactgtaggtctttgcagtagtgtcttagattatgtgaaatatggtattttggcaagtgtacatggctaagaacaagtggaatcagaattcaacttaagtttgcttgactccaaagcttatgtgttttccagtataatgtgctgcagtatcaatggtctgtatgaacaaaggccatatcatttttattgacaaagtatagaaacggggaaatggtgactgaactggaacttgcatcatctaattccataactgaggagacaatagcctggggactgcatgtatcccacaggatgttaaaaaattgagaaaatgttatttcatgatcttcacttctctgttgattataacttatttttgaagaggctaaaataaatggcaaactcttgtatggataagatataaaa

SEQ ID NO: 137324 - DNA, 2481 bp, Homo sapiens
  Payload ID: 6886
  Gene Symbol: GFOD1
  Gene Name: glucose-fructose oxidoreductase domain containing 1
  Uniprot ID: Q9NXC2
  ENST ID: ENST00000612338
  CDS Start-End: 230-1093
gcctgaataaaaggccgcacacgtgtgtcgggttttcttgggtgcgatagaggacctgcccttcagcagcggtggcgccctgctagggtcgtttgtttctttctgctgtgagttagtttagcgtgagattgcagatgttaccatcggctggaattatttcgtctgcgctggaggcatcggcaagaacgtcatctgcgaccgcacggccacgccgctggacgctttccgcatgacctcggccgcccactactaccccaagctcatgagcatcatgggcaacgtgctgcgcttcctgccggctttcgtgcgcatgaagcagctgatcgaggagggctacgtgggcgagccgctggtgtgtgaggtgcaggtgcacggcggcagcctgctgggcaagaagtacaactggagctgcgacgacttgatgggcggcggcggcctgcactccgtgggcacctacatcatcgacctgctcaccttcctcaccggccaaaaggccgtcaaggtccacgggctgctcaagaccttcgtgaagcagactgaccacatcaagggcatccgacagatcaccagcgatgacttctgcaccttccagatggtgctggagggcggggtgtgctgcaccgtcaccctcaacttcaacgtgcccggcgagttcaagcaggatgtcactgtggtgggctcagccgggcgcctgctggccgtgggcaccgacctgtacgggcagcgcaacagcgccccggagcaggagctgctggtgcaggacgccacgccggtgagcaactccctgcttccggagaaggccttcagcgacatcccctcgccctacctgcgcggcaccatcaagatgatgcaggcggtgcgccaggccttccaggaccaggacgaccggcgcacgtgggatgggcggcccctcaccatggccgccaccttcgacgactgcctgtatgccttgtgcgtggtggacaccatcaagaggtccagccagacgggcgagtggcagaacattgccatcatgaccgaggagccggagctgagccccgcctacctgatcagcgaggccatgcgccgcagcaggatgtccctctactgttagcacagattgagaacctcggggacttgagccttctgcaggggatgtccacagagagggaagggccgaggggagagggtgaccatggggaatgtggggatcagggaggtggagggacagtgtgaataaatggcatctaggaaggtaaactccaatcccggtgaccgaccccaaaccagactgttggtgggctgagctcctagcctggaagcattcaggagagcctgccattcctgggatgatccctgctgggtatttgcacgagagtggtttggtttagctgcctctgctgccctttactgtgacaagcaaggaggggttgcttccctccctacctcatccatcccacacaccttggccttctgcaagccaagtggttctgcaaggtcaaggcactagtatcagatggcaagctcagtgcccgggatacccactgctggcaggagaaggcccattttcacagtccacagaagcgtgttaggctggggttgggggtgggatgggctggtgagaaagttcaaattccaggaagccactttttattggatataaggtatctaacggcaaaagtacttagtagcaaagtggccaccttttgattgattgggcttcctcataggaagcactgagggtgtgtctttgtacttggttcattgcccttcacctggtagagaaagagaggtcagaaatagcaagcaaaaagcaggactcccaggagccacaagaaaagagcacaggctgcaccaaagcaggggcagcagagaataaaatatccctttgaacttgtcaacaattaaaaaactgcaaggagtcaccttataacactatttccagtaaaggtggaattgagtatcagagggattactgcggtgttaaggtagccctgccacgtggctctccaggcagggccaagaagacagcacaaagtatgggtttggccataagctcatatgctgcccccaaagactggggagagctgtgtgcctcagtgttgcagtgtgaattcctaaatagagggtaaagtgagcctagccaggaggtgtttggggctctatcgcgcatctctcctaccaagctgggcaagagcttttaggagattcatccagctttgtggatttagaaaggaagccttcagttccaatcagaatcctctttccttacaaaaaaaaaaaaaaaaaaaaaaaaaaaaaggattttccttagctccagcatttgctttcaggattctgacacctgagaatttgggggtaggtactaaacgaaacaaaacaaaaggacaacaaggaacattatttctagtgtttctaaaatgggggtttagaaccccttaaggggccatacttaggcttgaaaaggctaatgttggaaaaaacatgttcttctaattggtc

SEQ ID NO: 137325 - DNA, 2126 bp, Homo sapiens
  Payload ID: 6887
  Gene Symbol: GFOD2
  Gene Name: glucose-fructose oxidoreductase domain containing 2
  Uniprot ID: Q3B7J2
  ENST ID: ENST00000268797
  CDS Start-End: 347-1504
cagctcccggctacggcccctcccagcgcaggcccatccccgttatggagcatgcgcagtcctcctgccgtcccgcccctccctttccagagcccccagttccttagaaaccaggcggcgcgttcccggtggcggcgccctggactcccgggcccgcgcatccccgccagccttccttaaggcggatgggtggcccccgagaccccgtcggacccatggtttccagtgcagcgcggagtgggcgatgccagcgtgccaggagccatgtctgaccaggacgtttggaagatcatatccatgccagaggctcttgtgaggagatgagttggtaaagagagaggctgggatgaagatgctgccaggagtgggcgtgtttgggactggcagctccgcccgagttctggtcccactgctgagggcagaagggttcactgttgaggccctgtgggggaagactgaggaggaggcgaagcagcttgctgaggagatgaacatcgccttctacaccagccggactgatgacatcttgctgcatcaagatgtggatctggtgtgcatcagcatcccccctccactcacccggcagatatccgtgaaggctctaggtattgggaagaatgtggtttgcgagaaggcagcaacatcggtggatgccttccggatggtgacagcctcgcgctactacccgcagctcatgagcctggtagggaacgtgctgcgcttcctgcctgccttcgtgcgcatgaaacagctgatttcggaacactatgtgggagcggtgatgatctgtgatgcccgcatctactcaggcagcctgctgagccccagctatggctggatctgtgatgagctcatgggcggcgggggcttgcacaccatggggacctacattgtggacctgctgacccacctgaccggccggagagccgagaaggtgcacgggctgctcaagacattcgtgaggcagaacgctgccatccgtggcatccggcacgtcactagcgatgacttctgtttcttccagatgctcatgggtgggggtgtgtgtagcacagtgacactcaacttcaacatgccaggcgcctttgtgcatgaagtcatggtggtaggctctgcaggacgcctcgtcgcccggggagccgacctctatgggcagaagaactctgccacgcaagaggagctgctcttgagggactcgctggcagtgggcgcaggactgcctgagcaggggccccaggatgtcccgctgctgtacctgaagggcatggtctacatggtgcaggccttgcgccagtccttccaggggcagggcgaccgccgcacctgggaccgcacccctgtctccatggccgcctccttcgaggatgggctgtacatgcagagcgtggtggatgccatcaagaggtcgagccgatccggggagtgggaggctgtggaggtgctgacggaggagcccgacaccaaccagaacctgtgtgaggcacttcagcggaacaacctatgagcctgcacctgggctccttgccacagggcagagggaccagggaggggaacaggagccagacatgacagggacttggccctagcagagacagtgtctttcatttaatgagtctgggtgaagccagaggtggctctgggacttcgccccctccagtggctcatctgctcctcagacttgcagggtggcaaatgttcctgttgccaggttaccacggtgtgcacagggcagagctgccgccaggcctcctcatggtgatgccagtgagtcggaccaggaaaggctcaccctggggagcccttcagcctgatccgcagtcctaacagggtgagaaagcacaagaggggccagctcggctgaggcctgaggagaaatgatgagaagttttgtttcgttcttgggctggggcatctcaggaacagtgagggcaacaagctgtccctcagggaccctcacctgccctcccatgtgaccaggcccttcccaggtggggactggggcttgctttattaagtgagctcttgggcttttgaagtaggacagagggccctggtttggcagagaggaggcaagggagggctttagaacatctgagaaatgttaataaataattcagaaaatagga

SEQ ID NO: 137326 - DNA, 2029 bp, Homo sapiens
  Payload ID: 6887
  Gene Symbol: GFOD2
  Gene Name: glucose-fructose oxidoreductase domain containing 2
  Uniprot ID: Q3B7J2
  ENST ID: ENST00000602496
  CDS Start-End: 250-588
agttccttagaaaccaggcggcgcgttcccggtggcggcgccctggactcccgggcccgcgcatccccgccagccttccttaaggcggatgggtggcccccgagaccccgtcggacccatggtttccagtgcagcgcggagtgggcgatgccagcgtgccaggagccatgtctgaccaggacgtttggaagatcatatccatgccagaggctcttgtgaggagatgagttggtaaagagagaggctgggatgaagatgctgccaggagtgggcgtgtttgggactggcagctccgcccgagttctggtcccactgctgagggcagaagggttcactgttgaggccctgtgggggaagactgaggaggaggcgaagcagcttgctgaggagatgaacatcgccttctacaccagccggactgatgacatcttgctgcatcaagatgtggatctggtgtgcatcagcatcccccctccactcacccggcagatatccgtgaaggctctaggtacgcccggcaggccacagcaggggcagatcatgtctctccctctgggcagtcctctgagggtcactcctctcctctgagctctccttcctgggctcgcatctgcagggaggagaactctgggacatcacttgtccctgaagcagtgcttggggagggcatgaaaaaagacatagcctaacctacctcccatctgtaaatccctgaacagaaattaaggaaatactctaagagacagccatcaaggggctggagatggttgcatctcagtcaacataaagtttgcctctgtgaagttagaggtcagagccctgggtggcggggaattggttgtgactagtgtgtttgttctcccatttctggggcacacagcaccacaggaaggagaggctgtgtagcaaggctaccatttcccatgttttgtcagcgtttgactatagtgagcacacacccttcctgccaaactgcagtcttgtattgccggaggacaggaaggctctgccagcattgggcttccctgacaggatccgtcgacagcctgcttacatgacatctccactcccttgggaagttttgggcttggtaacctcttgcccctgactgggcatggcctgctgagctgttctcctacagttcccgttggtcttctatttccagtcaactggagtcaacttcttctctttatctaatataaatcagaacctagtttactaagtaaacaaaccagtaaacattcagccagcaatttttattttattttgagacagagtttccctcttgttgcaatgagccaagattataccactgggtaacaaagcgagtccccatctaaaaaaacaaaaacagactatttttcagattcaagaagagaggtctttccctctttcctcacctcttgaggcatgaaacaggaattccttatcctagttttatcaccaccaaactcctagcagtcataaaagtcctttttcctctaaacccacctcctctctgcctcacactgcagtatccactctgtcgccagcagcgaggcattatagcaggaggcttctgaattggccagaacagcagctctcaggtggggtgtctgagaacctcatttcctcattacatccctccctggtcagccatatgtgttcagcagccaaatggcaaaattcacccccagaactgtgattgtcttccctaatctggaaggcccacaagtgtggagaagcactggagaccctccagaagcagtagtgctagcagtcaggggctactctccctgccgggccccgtgcaagggcctggccaccctatcccaggtatgtgacacttggctggctgttctttattgtcctgctagtacctgttgtaaagcttcttttattaaagaagagcaggagattgaagtgtcataaattgaagagattcacaccaacacggcacatgtatacatatgtaacaaacctgcacgttgtgcacatgtaccctagaacttaaagtataataacaaaatatgtattaaaaaaataaata

SEQ ID NO: 137327 - DNA, 819 bp, Homo sapiens
  Payload ID: 6887
  Gene Symbol: GFOD2
  Gene Name: glucose-fructose oxidoreductase domain containing 2
  ENST ID: ENST00000602855
  CDS Start-End: 256-528
gcccccagttccttagaaaccaggcggcgcgttcccggtggcggcgccctggactcccgggcccgcgcatccccgccagccttccttaaggcggatgggtggcccccgagaccccgtcggacccatggtttccagtgcagcgcggagtgggcgatgccagcgtgccaggagccatgtctgaccaggacgtttggaagatcatatccatgccagaggctcttgtgaggagatgagttggtaaagagagaggctgggatgaagatgctgccaggagtgggcgtgtttgggactggcagctccgcccgagttctggtcccactgctgagggcagaagggttcactgttgaggccctgtgggggaagactgaggaggaggcgaagcagcttgctgaggagatgaacatcgccttctacaccagccggactgatgacatcttgctgcatcaagatgtggatctggtgtgcatcagcatcccccctccactcacccggcagatatccgtgaaggctctagagagctctctctgaggatgtgtgacattggagttattcattcattggtcaccaaatgcttgggaggtcagatggtggctcccagattgaattcagaaatagacctaagtcaacactttagcagcaagttggttcaaggggaagcaagccgctattggtcacttgactccttgccatcccttgtggcttgaatgcaggctggaaaggtgaggtgtgtccggagccagaactctggaggctctcagtcttcttcctgaattttagggttccccacagagaccatttccaagctatacgggaagaaag

SEQ ID NO: 137328 - DNA, 1991 bp, Homo sapiens
  Payload ID: 6887
  Gene Symbol: GFOD2
  Gene Name: glucose-fructose oxidoreductase domain containing 2
  ENST ID: ENST00000602377
  CDS Start-End: 265-531
ctttccagagcccccagttccttagaaaccaggcggcgcgttcccggtggcggcgccctggactcccgggcccgcgcatccccgccagccttccttaaggcggatgggtggcccccgagaccccgtcggacccatggtttccagtgcagcgcggagtgggcgatgccagcgtgccaggagccatgtctgaccaggacgtttggaagatcatatccatgccagaggctcttgtgaggagatgagttggtaaagagagaggctgggatgaagatgctgccaggagtgggcgtgtttgggactggcagctccgcccgagttctggtcccactgctgagggcagaagggttcactgttgaggccctgtgggggaagactgaggaggaggcgaagcagcttgctgaggagatgaacatcgccttctacaccagccggactgatgacatcttgctgcatcaagatgtggatctggtattgggaagaatgtggtttgcgagaaggcagcaacatcggtggatgccttccggatggtgacagcctcgcgctactacccgcagctcatgagcctggtagggaacgtgctgcgcttcctgcctgccttcgtgcgcatgaaacagctgatttcggaacactatgtgggagcggtgatgatctgtgatgcccgcatctactcaggcagcctgctgagccccagctatggctggatctgtgatgagctcatgggcggcgggggcttgcacaccatggggacctacattgtggacctgctgacccacctgaccggccggagagccgagaaggtgcacgggctgctcaagacattcgtgaggcagaacgctgccatccgtggcatccggcacgtcactagcgatgacttctgtttcttccagatgctcatgggtgggggtgtgtgtagcacagtgacactcaacttcaacatgccaggcgcctttgtgcatgaagtcatggtggtaggctctgcaggacgcctcgtcgcccggggagccgacctctatgggcagaagaactctgccacgcaagaggagctgctcttgagggactcgctggcagtgggcgcaggactgcctgagcaggggccccaggatgtcccgctgctgtacctgaagggcatggtctacatggtgcaggccttgcgccagtccttccaggggcagggcgaccgccgcacctgggaccgcacccctgtctccatggccgcctccttcgaggatgggctgtacatgcagagcgtggtggatgccatcaagaggtcgagccgatccggggagtgggaggctgtggaggtgctgacggaggagcccgacaccaaccagaacctgtgtgaggcacttcagcggaacaacctatgagcctgcacctgggctccttgccacagggcagagggaccagggaggggaacaggagccagacatgacagggacttggccctagcagagacagtgtctttcatttaatgagtctgggtgaagccagaggtggctctgggacttcgccccctccagtggctcatctgctcctcagacttgcagggtggcaaatgttcctgttgccaggttaccacggtgtgcacagggcagagctgccgccaggcctcctcatggtgatgccagtgagtcggaccaggaaaggctcaccctggggagcccttcagcctgatccgcagtcctaacagggtgagaaagcacaagaggggccagctcggctgaggcctgaggagaaatgatgagaagttttgtttcgttcttgggctggggcatctcaggaacagtgagggcaacaagctgtccctcagggaccctcacctgccctcccatgtgaccaggcccttcccaggtggggactggggcttgctttattaagtgagctcttgggcttttgaagtaggacagagggccctggtttggcagagaggaggcaagggagggctttagaacatctgagaaatgttaataaataattcagaaaataggaca

SEQ ID NO: 137329 - DNA, 5507 bp, Homo sapiens
  Payload ID: 6887
  Gene Symbol: GFOD2
  Gene Name: glucose-fructose oxidoreductase domain containing 2
  Uniprot ID: Q3B7J2
  ENST ID: ENST00000602279
  CDS Start-End: 226-564
gttcccggtggcggcgccctggactcccgggcccgcgcatccccgccagccttccttaaggcggatgggtggcccccgagaccccgtcggacccatggtttccagtgcagcgcggagtgggcgatgccagcgtgccaggagccatgtctgaccaggacgtttggaagatcatatccatgccagaggctcttgtgaggagatgagttggtaaagagagaggctgggatgaagatgctgccaggagtgggcgtgtttgggactggcagctccgcccgagttctggtcccactgctgagggcagaagggttcactgttgaggccctgtgggggaagactgaggaggaggcgaagcagcttgctgaggagatgaacatcgccttctacaccagccggactgatgacatcttgctgcatcaagatgtggatctggtgtgcatcagcatcccccctccactcacccggcagatatccgtgaaggctctaggtacgcccggcaggccacagcaggggcagatcatgtctctccctctgggcagtcctctgagggtcactcctctcctctgagctctccttcctgggctcgcatctgcagggaggagaactctgggacatcacttgtccctgaagcagtgcttggggagggcatgaaaaaagacatagcctaacctacctcccatctgtaaatccctgaacagaaattaaggaaatactctaagagacagccatcaaggggctggagatggttgcatctcagtcaacataaagtttgcctctgtgaagttagaggtcagagccctgggtggcggggaattggttgtgactagtgtgtttgttctcccatttctggggcacacagcaccacaggaaggagaggctgtgtagcaaggctaccatttcccatgttttgtcagcgtttgactatagtgagcacacacccttcctgccaaactgcagtcttgtattgccggaggacaggaaggctctgccagcattgggcttccctgacaggatccgtcgacagcctgcttacatgacatctccactcccttgggaagttttgggcttggtaacctcttgcccctgactgggcatggcctgctgagctgttctcctacagttcccgttggtcttctatttccagtcaactggagtcaacttcttctctttatctaatataaatcagaacctagtttactaagtaaacaaaccagtaaacattcagccagcaatttttattttattttgagacagagtttccctcttgttgcccaggctggagttcaatggcgcaatcccggctcactgcaaccttcgcctcccaggttcaagtgattctcctgcctcagcctcccaagtagctgggattacaggtgcctgccaccacacccagctaatttttgtatttttagtagagacagggtttcaccacattggccaggctggtctcgaactcctgacctcaggtgatccatccgcctcggcctcccaaagtgctgggattacaggtgtgagccaccatgcccagcatttttttaaaattattattattattttattttatttttttagatggagtctcactctgttgcccaggctggagtgtgcattggtgcaatctcagctcactgcaacctccacctcccaggttcaagcgatactcctgcctcggctttgcaagtagccaggactacaggcatgtgccaccacgcccagctaatttttgtctttttagtacagatggggttttgttatgttggccaggctggtctcgggctcctgacctcaggtgatccacctgccttggccgcctcccaaagtgctgggattacaggcaggagccaccacacccagcctcaattatttttttaatgcctcctgtgtgccagtcactgtcctgatgtcattttggacattcaaagctgtgttagattggacccctccctgtcttcagattttatagtccaattgaggcaactagaaataacacacattacaaggtagatgacagaagacatagtcacaattcaactagcacatacttacttgactgagtaactgttttatgtgaggtaataggagccaagtgtctccttgatgcagccgaagatctctaggtcgaggaaccggtgccatgaggttgtcctccactcttcctgaccactgccatggtggcaaacctcagggtctgctacttatctcctccctcattctgaggaatgtcataggaaggtgtctgtcacctctggctcagtgggtagggaaggataaatgttctttgaagtgagaaagaacttcagtctgtccggttgtcaatttggagcaagtaagttttggccttattgtttgtttcttccagagagctctctctgaggatgtgtgacattggagttattcattcattggtcaccaaatgcttgggaggtcagatggtggctcccagattgaattcagaaatagacctaagtcaacactttagcagcaagttggttcaaggggaagcaagccgctattggtcacttgactccttgccatcccttgtggcttgaatgcaggctggaaaggtgaggtgtgtccggagccagaactctggaggctctcagtcttcttcctgaattttagggttccccacagagaccatttccaagctatacgggaagaaagaggaaaccccagggttctttggcaacaagcttgctttttttctggttcttggtatgctccaccagcagcagcatcacctgggagcttgttagaaactgaattctcagctgggcaacatagtgggatcccgtctctacaaaaaagtttaaaaattagccaggcatggtggcacgcgactgtggtcccagctacttgggaggctgaggcagaaggatcgcttgagcccaggagatagaggctgcagtgagcagtgatcatgcactccagcttgagtgacagagtaagactgtctcaaaagcaaacaaacaaaaagaaatctaaattctcaggccccactccaaacctactgaatctctgggatccagctatctgtgtctgaacaagccttgcaggtgactctggtggacatgaaggattgagagccactgatccaatcattttgaattaaactgaggcccaggagcattaaggaatgacatcttggttacatttcaccaagtcttcgtgctgtgatttttctctccttgctagagctttatatttttaccttacttctaaggccacgagatcatttcttgccctcattattagtttttcctaaaattaatgattggacttaaccttccagagataatacttttcatatcacagctctttttatggcatcttgttttctgctttggtctgacctatgttcttcatcttctacctccgatttcatccttaaagctttcccatgaatttcttaaaggggagaggggaagggccctaatatattttattcttcagttcagaagtggttcaggaaattatattttaagtgcaaggtgcccctagcatctttgccacagttgaatgttttcttaagtctgtcactaaaaggtgggcttctgtgcccaattcttggcacttctgtggttcattagaaaaacactaagtttgcaggccaggcttggtggctcatgcatgtaatcccagcactttgggaggccgaggcgggcggatcacaaggtcaggagtttgagaccagcctgaccaacctggtgaaacctcgtctatactaaaaacacaaaaattagctgggcgtgttggcacgtgcctatagtcccagctactcaggaggctgaggcaggagaattgcttgaacccaggagatggaggttgcagtgagccgagatcacgccactgcactccagtctgggtgacagagcgagactccatctcaaaaaaaaaagaaaagaaaagtaaaaagaaaacatttttgtagagacaggatcttgctgtgttgttcaagctggtttcgaactcctaacctcaggcaatcatcctactttggccccccaaagtgctggaattataggtgggagccactgtgcccagcagatttcagcttctccaatctctcccttgacttcctggcaggagagctagataaactcaggtagacatgtctttcatggctacccaaagactctgtacagctagccctcaggagcctgtttaagtcaagatgtccttgcagtcccacactgatactactgagccctaagtttaagagtgctgttattcagggttgggctcagtgcctcacacctctaatccagcactttgggaggccaaggtgggcagatcgcttgaactcaggagttaaataccagcctgagcaacatgatgaaatcccatctctaccaaaaatacaaaaaattagctgggcacagtggcgtgcacctgtggtcccagctacttgggaggctgaggtgggaggttagcttgagcccaggaagcggaggttgcaatgagccaagattataccactgggtaacaaagcgagtccccatctaaaaaaacaaaaacagactatttttcagattcaagaagagaggtctttccctctttcctcacctcttgaggcatgaaacaggaattccttatcctagttttatcaccaccaaactcctagcagtcataaaagtcctttttcctctaaacccacctcctctctgcctcacactgcagtatccactctgtcgccagcagcgaggcattatagcaggaggcttctgaattggccagaacagcagctctcaggtggggtgtctgagaacctcatttcctcattacatccctccctggtcagccatatgtgttcagcagccaaatggcaaaattcacccccagaactgtgattgtcttccctaatctggaaggcccacaagtgtggagaagcactggagaccctccagaagcagtagtgctagcagtcaggggctactctccctgccgggccccgtgcaagggcctggccaccctatcccaggtatgtgacacttggctggctgttctttattgtcctgctagtacctgttgtaaagcttcttttattaaagaagagcaggagattgaagtgtcataaattgaagagattcacaccaacacggcacatgtatacatatgtaacaaacctgcacgttgtgcacatgtaccctagaacttaaagtataataacaaaatatgtattaaaaaaataaataaataaattgaagagattgaatgatgtcatagactaccaatccacatgccttgttccttgctgcagcactgaggtttgtaatcctgggagtttagacctacgtaagatgcccataagtacaaatgacagatgctctgtggggttcttcagggtcaaggtggcagaggtgggggtaggaagtgagaggagggggaagggttgaccagaggcaccaatttgtctcctgtgggcttggtcagtatgtgagctaccagggggccaggctgggcctgactctcggagaggcctaataaacagtacgtatgataaaacaact

SEQ ID NO: 137330 - DNA, 402 bp, Homo sapiens
  Payload ID: 6887
  Gene Symbol: GFOD2
  Gene Name: glucose-fructose oxidoreductase domain containing 2
  ENST ID: ENST00000602627
  CDS Start-End: 1-311
ggaagactgaggaggaggcgaagcagcttgctgaggagatgaacatcgccttctacaccagccggactgatgacatcttgctgcatcaagatgtggatctggtgtgcatcagcatcccccctccactcacccggcagatatccgtgaaggctctaggaagtacctgtggagtgccagagtggagcctggatggctgtggaggagaagcccaggtgcacacattgcccagatgggcttcaactagaagggtattgggaagaatgtggtttgcgagaaggcagcaacatcggtggatgccttccggatggtgacagcctcgcgctactacccgcagctcatgagcctggtagggaacgtgctgcgcttcctgcctgccttcgtgcgcatgaaacagctgatttc

SEQ ID NO: 137331 - DNA, 3626 bp, Homo sapiens
  Payload ID: 6888
  Gene Symbol: GAA
  Gene Name: glucosidase, alpha
  acid
  Uniprot ID: P10253
  ENST ID: ENST00000302262
  CDS Start-End: 220-3078
cagttgggaaagctgaggttgtcgccggggccgcgggtggaggtcggggatgaggcagcaggtaggacagtgacctcggtgacgcgaaggaccccggccacctctaggttctcctcgtccgcccgttgttcagcgagggaggctctgcgcgtgccgcagctgacggggaaactgaggcacggagcgggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgttgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcatgtccacagccgggcaccgtccccactctacagcgtggagttctccgaggagcccttcggggtgatcgtgcgccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccagtggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcaggggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccagtagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaatc

SEQ ID NO: 137332 - DNA, 3549 bp, Homo sapiens
  Payload ID: 6888
  Gene Symbol: GAA
  Gene Name: glucosidase, alpha
  acid
  Uniprot ID: P10253
  ENST ID: ENST00000390015
  CDS Start-End: 145-3003
tccgcgggcggccagggcgcgcgtgcgcggaggttctcctcgtccgcccgttgttcagcgagggaggctctgcgcgtgccgcagctgacggggaaactgaggcacggagcgggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgttgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcatgtccacagccgggcaccgtccccactctacagcgtggagttctccgaggagcccttcggggtgatcgtgcgccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccagtggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcaggggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccagtagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaa

SEQ ID NO: 137333 - DNA, 812 bp, Homo sapiens
  Payload ID: 6888
  Gene Symbol: GAA
  Gene Name: glucosidase, alpha
  acid
  ENST ID: ENST00000577106
  CDS Start-End: 187-812
cggagtctccgcgggcggccagggcgcgcgtgcgcggaggttctcctcgtccgcccgttgttcagcgagggaggctctgcgcgtgccgcagctgacggggaaactgaggcacggagcgggtgagacacctgacgtctgccccgcgctgccggcggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgttgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcatgtccacagccgggcaccgtccccactcta

SEQ ID NO: 137334 - DNA, 723 bp, Homo sapiens
  Payload ID: 6888
  Gene Symbol: GAA
  Gene Name: glucosidase, alpha
  acid
  ENST ID: ENST00000572080
  CDS Start-End: 1-281
tggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagcctgaggaccagcctgactctgccctcccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttcccc

SEQ ID NO: 137335 - DNA, 956 bp, Homo sapiens
  Payload ID: 6888
  Gene Symbol: GAA
  Gene Name: glucosidase, alpha
  acid
  ENST ID: ENST00000570803
  CDS Start-End: 103-956
acccgcctctgcgcgcccccgggcacgaccccggagtctccgcgggcggccagggcgcgcgtgcgcggaggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgttgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcatgtccacagccgggcaccgtccccactctacagcgtggagttctccgaggagcccttcggggtgatcgtgcgccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcc

SEQ ID NO: 137336 - DNA, 3906 bp, Homo sapiens
  Payload ID: 6889
  Gene Symbol: GANAB
  Gene Name: glucosidase, alpha
  neutral AB
  Uniprot ID: Q14697
  ENST ID: ENST00000346178
  CDS Start-End: 17-2917
gcaaactctgcacaagatggcggcggtagcggcagtggcggcgcgtaggaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctctttctcggataaggttaatctcacgcttggtagcatatgggataagatcaagaaccttttctctaggcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaataa

SEQ ID NO: 137337 - DNA, 3608 bp, Homo sapiens
  Payload ID: 6889
  Gene Symbol: GANAB
  Gene Name: glucosidase, alpha
  neutral AB
  Uniprot ID: Q14697
  ENST ID: ENST00000356638
  CDS Start-End: 18-2852
agcaaactctgcacaagatggcggcggtagcggcagtggcggcgcgtaggaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatca

SEQ ID NO: 137338 - DNA, 3718 bp, Homo sapiens
  Payload ID: 6889
  Gene Symbol: GANAB
  Gene Name: glucosidase, alpha
  neutral AB
  Uniprot ID: Q14697
  ENST ID: ENST00000532402
  CDS Start-End: 4-162
aagatggcggcggtagcggcagtggcggcgcgtaggaggcggtcttgggcgtctttggtactggcttttttaggggtctgcctggggattacccttgctgtggatagaagcaactttaagacctgtgaagagagttctttctgcaagtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaataa

SEQ ID NO: 137339 - DNA, 577 bp, Homo sapiens
  Payload ID: 6889
  Gene Symbol: GANAB
  Gene Name: glucosidase, alpha
  neutral AB
  ENST ID: ENST00000529737
  CDS Start-End: 25-255
gtcaaggagcaaactctgcacaagatggcggcggtagcggcagtggcggcgcgtaggaggcggtcttgggcgtctttggtactggcttttttaggggtctgcctggggattacccttgctgtggatagaagcaactttaagacctgtgaagagagttctttctgcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggt

SEQ ID NO: 137340 - DNA, 533 bp, Homo sapiens
  Payload ID: 6889
  Gene Symbol: GANAB
  Gene Name: glucosidase, alpha
  neutral AB
  Uniprot ID: Q14697
  ENST ID: ENST00000526210
  CDS Start-End: 15-173
aaactctgcacaagatggcggcggtagcggcagtggcggcgcgtaggaggcggtcttgggcgtctttggtactggcttttttaggggtctgcctggggattacccttgctgtggatagaagcaactttaagacctgtgaagagagttctttctgcaagtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgtgagtacaggggttgggactgcagggaacctagtgtgaaagagcataggggtgttgtgaggtctggc

SEQ ID NO: 137341 - DNA, 390 bp, Homo sapiens
  Payload ID: 6889
  Gene Symbol: GANAB
  Gene Name: glucosidase, alpha
  neutral AB
  ENST ID: ENST00000525994
  CDS Start-End: 34-390
aggtttggggtcaaggagcaaactctgcacaagatggcggcggtagcggcagtggcggcgcgtaggaggcggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctctttctcggataaggttaatctcacgcttggtagcatatgggataagatcaagaaccttttctctaggcaaggatcaaaagacccagctgagggcgatggggcccagcctgaggaaacacccagggatggcgacaaggca

SEQ ID NO: 137342 - DNA, 737 bp, Homo sapiens
  Payload ID: 6889
  Gene Symbol: GANAB
  Gene Name: glucosidase, alpha
  neutral AB
  Uniprot ID: Q14697
  ENST ID: ENST00000534613
  CDS Start-End: 18-176
agcaaactctgcacaagatggcggcggtagcggcagtggcggcgcgtaggaggcggtcttgggcgtctttggtactggcttttttaggggtctgcctggggattacccttgctgtggatagaagcaactttaagacctgtgaagagagttctttctgcaagtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctctttctcggataaggttaatctcacgcttggtagcatatgggataagatcaagaaccttttctctaggcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagc

SEQ ID NO: 137343 - DNA, 2626 bp, Homo sapiens
  Payload ID: 6889
  Gene Symbol: GANAB
  Gene Name: glucosidase, alpha
  neutral AB
  ENST ID: ENST00000534779
  CDS Start-End: 34-2592
aggtttggggtcaaggagcaaactctgcacaagatggcggcggtagcggcagtggcggcgcgtaggaggcggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctctttctcggataaggttaatctcacgcttggtagcatatgggataagatcaagaaccttttctctaggcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaagg

SEQ ID NO: 137344 - DNA, 3836 bp, Homo sapiens
  Payload ID: 6889
  Gene Symbol: GANAB
  Gene Name: glucosidase, alpha
  neutral AB
  ENST ID: ENST00000540933
  CDS Start-End: 310-2853
agacagctgcccggcggcgctcaggtcgaaccaatcataaggccggaaggggcgggaactaggatacgtggctgagcgcgcgcgatggggcgggaggtttggggtcaaggagcaaactctgcacaagatggcggcggtagcggcagtggcggcgcgtaggaggcggtcttgggcgtctttggtactggcttttttaggggtctgcctggggattacccttgctgtggatagaagcaactttaagacctgtgaagagagttctttctgcaagtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccat

SEQ ID NO: 137345 - DNA, 7781 bp, Homo sapiens
  Payload ID: 6890
  Gene Symbol: GANC
  Gene Name: glucosidase, alpha
  neutral C
  Uniprot ID: Q8TET4
  ENST ID: ENST00000318010
  CDS Start-End: 241-2985
ataatcaagacaaatttgccaaataaatcattgtagaaacgctagtttgggcctgaaaaattccaggagcaagagtcaagatttgtcactccatgagaatctggaggggactcccttcccagaaacttgacgatgaagtactggttgtaattttagaaagacacccaatcggcttttttaaaagatcgcccagggcccttgtcctgagagctgggagctggtcggagtgacagagaagccatggaagcagcagtgaaagaggaaataagtcttgaagatgaagctgtagataaaaacattttcagagactgtaacaagatcgcattttacaggcgtcagaaacagtggctttccaagaagtccacctatcaggcattattggattcagtcacaacagatgaagacagcaccaggttccaaatcatcaatgaagcaagtaaggttcctctcctggctgaaatttatggtatagaaggaaacattttcaggcttaaaattaatgaagagactcctctaaaacccagatttgaagttccggatgtcctcacaagcaagccaagcactgtaaggctgatttcatgctctggggacacaggcagtctgatattggcagatggaaaaggagacctgaagtgccatatcacagcaaacccattcaaggtagacttggtgtctgaagaagaggttgtgattagcataaattccctgggccaattatactttgagcatctacagattcttcacaaacaaagagctgctaaagaaaatgaggaggagacatcagtggacacctctcaggaaaatcaagaagatctgggcctgtgggaagagaaatttggaaaatttgtggatatcaaagctaatggcccttcttctattggtttggatttctccttgcatggatttgagcatctttatgggatcccacaacatgcagaatcacaccaacttaaaaatactggtgatggagatgcttaccgtctttataacctggatgtctatggataccaaatatatgataaaatgggcatttatggttcagtaccttatctcctggcccacaaactgggcagaactataggtattttctggctgaatgcctcggaaacactggtggagatcaatacagagcctgcagtagagtacacactgacccagatgggcccagttgctgctaaacaaaaggtcagatctcgcactcatgtgcactggatgtcagagagtggcatcattgatgtttttctgctgacaggacctacaccttctgatgtcttcaaacagtactcacaccttacaggcacacaagccatgccccctcttttctctttgggataccaccagtgccgctggaactatgaagatgagcaggatgtaaaagcagtggatgcagggtttgatgagcatgacattccttatgatgccatgtggctggacatagagcacactgagggcaagaggtacttcacctgggacaaaaacagattcccaaaccccaagaggatgcaagagctgctcaggagcaaaaagcgtaagcttgtggtcatcagtgatccccacatcaagattgatcctgactactcagtatatgtgaaggccaaagatcagggcttctttgtgaagaatcaggaaggggaagactttgaaggggtgtgttggccaggtctctcctcttacctggatttcaccaatcccaaggtcagagagtggtattcaagtctttttgctttccctgtttatcagggatctacggacatcctcttcctttggaatgacatgaatgagccttctgtctttagagggccagagcaaaccatgcagaagaatgccattcatcatggcaattgggagcacagagagctccacaacatctacggtttttatcatcaaatggctactgcagaaggactgataaaacgatctaaagggaaggagagaccctttgttcttacacgttctttctttgctggatcacaaaagtatggtgccgtgtggacaggcgacaacacagcagaatggagcaacttgaaaatttctatcccaatgttactcactctcagcattactgggatctctttttgcggagctgacataggcgggttcattgggaatccagagacagagctgctagtgcgttggtaccaggctggagcctaccagcccttcttccgtggccatgccaccatgaacaccaagcgacgagagccctggctctttggggaggaacacacccgactcatccgagaagccatcagagagcgctatggcctcctgccatattggtattctctgttctaccatgcacacgtggcttcccaacctgtcatgaggcctctgtgggtagagttccctgatgaactaaagacttttgatatggaagatgaatacatgctggggagtgcattattggttcatccagtcacagaaccaaaagccaccacagttgatgtgtttcttccaggatcaaatgaggtctggtatgactataagacatttgctcattgggaaggagggtgtactgtaaagatcccagtagccttggacactattccagtgtttcagcgaggtggaagtgtgataccaataaagacaactgtaggaaaatccacaggctggatgactgaatcctcctatggactccgggttgctctaagcactaagggttcttcagtgggtgagttatatcttgatgatggccattcattccaatacctccaccagaagcaatttttgcacaggaagttttcattctgttccagtgttctgatcaatagttttgctgaccagaggggtcattatcccagcaagtgtgtggtggagaagatcttggtcttaggcttcaggaaggagccatcttctgtgactacccactcatctgatggtaaagatcagcctgtggcttttacgtattgtgccaaaacatccatcctgagcctggagaagctctcactcaacattgccactgactgggaggtccgcatcatatgacaaagaactgcccctggtgatgtgagcagggacctgcctgcccctttcaacctttcccctcaccttttttgagatttttgctgcaatctgtttgccttccctgaatcaaaataatctttcattcgtcaccattatactaatgaacaatagatttcatgtttcaaaatttcagattttacatgttaagatgtactaacaatattccttgtatcaaacatctccttttctccctgatacatagccctgagacatttatagcgttcaggagtcttctattgcttccattccttcagcagggctgcgtgggtctgttttaacgtgggccaagcctacctgggcagcccatttgccagggcttgcctcaggccatgcagcattggcgctctggctgcagcagctgagttgctcaaggccagtgtccaagtggacagcagcctctggtactccccccagttatcttccacccacatggactgggcagagcagccctcttctgtgtgcactgcatacgctgcagccgtgggagttattctcccctagagatcgacttggcagcacgaaggattcttttctctttcatgcttctcaggctcaatagtttctaattaatcttaaaatccatgtcttttacattgtttttttaattaagtgctgtttactaaccaaataatatttataacatgagtaagctataattaataacaatgaaataaatacccatgtacccaccactggacttcagaagtagaactcatgactgggactaggatgaggcaagggagaccctggccttgggcacaaaatgtaagggatgccaaaaaaatacagtaatcaaagtaagtaatatttcaatccaatatttttaaaaatcagaattaatgcaaaaaaaaccatgatgaacaaaatattaaaatttaaaataaagacaggattagtattactgagttttccttttgtcccaggctctaatatggcttggcatggggcagaacattacaacataccagtcgtgtcatggtgcccaaggctccacagacctcagtggctccctgctgcctgccacagcatctgttttagcagcctcgactcctcagcactcctcagcacacacctcttcttatcaggcttcctccacttagcaacttgctaacggccacctctgtgccttctgatccctgggcgccaatatcctcctgcccttaccatccttccaggcccaacttaaatcccactttcccatgaagcctaactgcgtgaacacccctacccccatacccattagcagtgattttgcccttccccgtaatgctgtcccacttataactgtgctctacttagcattctcagggatcataccttaatgttttcagtatgtctgcgttctcctactagattgtatgtccctcaagagcatgttctgtttctcttctgtctgacagagcactattatacctgactttcagtaactgttagctgtgattagttagctggtggatttaattgattaaaaaattacgattgaatgtatttccatctgatttgcttttctggtacaagattcttcccaaaggcaatcaacattgtgcatttccttgtggacacatttcatagtatgagttgagatttgagctctgcaccatatgtaagctcacagagacctgcacagattctttgctcctatttctgtaagttttgcagttgagaagaaaggagcaagcttatattagctgaagccatggtgcctatcttcaaatttcccttgccaacctaaaataaaacttagccagaagactgggtgctcctccctaatataaatgatagtttttaatagcatttacagttgaataagaactatctttaggtcaacatttattgcacgtctagtcttccatttaaaatattattggaggaatggagcagtaactagtagagtaagttaatgaggaactgctctgttttgacccaaatctatattgaaacatttggctagagacaagtggagacagcctgggtgtttttaatggttttctgctcttattgcttctcacactttacctacctcccatttctgaatttgtgtaccagagagcaacatggggctgagttggcctacaggtattgttacttttttgtggctaattcttaatatggtttcataggaaactggattttatataagaaattttattcatttcaacagggttcctaaaaaagctctaaaatgaatgcatagtgtgtctttccttcaagatgtaaatgtcaaggaatgagttggcaaatcagtttaaaaacacaaactacccaacagaaaaatgtaagtataatctttcagagtggcaatctggcaacaatataaaaaatattttaattttaataaaaatatgtgggggtctcactatgttgcccaggctagtcttgaactcccggactcaaacaatcctcctgccttgacctcccaaagggctggggctataggcatgagccactgtgcctggccttacctcctctgttggaacagttggcaacattggaatgggatcttttgattacatggtaatttttttacttttgagcattgtattaggatcatatagaagaattttcttggttttaagaaaaatacaattctggagtttggtctgtgtgcagaattccttcactttgtcacatccttttcactatcaaggcatcaaaatgataagcagcagaaacacagtcaaagcacataaacactgggagttgaatagtttttagctaattaaccactctgcctgaaagccttagtaatgagattcctaggatttccacctaccaaaccctcgaagggctactctagactaaaataacttctcaggccagtgggtagaaagccatcagcagctccactggaaacaggctatcatattagccactgacaatggaggccatatagctagcattctaggagaaatagcagagacattggcatcttatatcagatctgcttgtctcatgacaagccttgctaaaggctatagtgccacacgaagacttgccagaattagacagctgctgctgctttttttttttttttttttttttttattgagacagaatcttgctctgtcacccaggatggagtgcaatggcacgatctcggctaactgcaacctctgctttccgggttcaagcgattcttctgcctcagcatcctgagtaaccgagattacaggcatgctccaccaggcccagctaatttttgtatttttagtagagaaaggttttcaccatgttggccaggctgacctcgaactcctgacctcatgtaatccacctgcctctgcctcccaaagtgcaacagctgcttcttgacagttgtttccacccaggccgacggtattagattgctgtccaatcagagccagggaaaggggagcctgactatttacatgcaaggatacagagatcttatacctaattcacatcaattaaatcttagtcaagcatttacttccaaggaaatcaagagacctggagtctagtttgcttctacagtgaactggctgagtgatcttggccatggcatttgacctctctgggctttgttaaagaaaagagataatctctagcctgggtgcagtggcttacgcctgtaatcccagcactttgggaggccgaggcagggggttcacttgagttcaggagttcgagaccaacctggccaacatggtgaagccccatctctactaaaaataacaaaaattagcagggcatggtggcacatgcctgtaatctcagctgttcaggagactgaggcaggagaatcgcttgaacccgggaggcggaagttgcagtgagctaagattgcaccagtgcactccagcctggtgacagagagagactccatctaaaaaaaaaaaaagagagataatctctaaaattttgtgagttttctgatacttaactgtcaaaatacagcagatatctcaagtttcctcagttgtaaaatggacttagtgaaacttgcagagtttttctacaaatttaaaatatcttatgtgtacagaaagggaaaaatagtaacattaccagggagaaacccagtaaacatcactttaggcaagtgatcaaagttgacatcacctgtaataaaacctatcaatatcatgtgcccccaaatatggtttgaggaggtagccatgtcacatctgtgacagtcttcccctaaatccataacctcagtctaatcatgtgaaaaatatcagagaaacccaaatttagggtcattctacaaaaacctgacaagtactcttcaaaagtgtcacggtcatgagagacaaagactgtggaatgatcagagactggaggacactatctttgcaactcttttgtaagtctttgcaagtcttttgtaagtctaaaattattttaaaataaaaagttttttaaaggtctctgtgaagtggctagctcccagtaggcacttaatgaatgagaggtattataatgataagcaaagacattgcttccaatagtgttagtaatcaaagaaatgcttcttggtggaaaagacagagccattagttggcaatgctgtgcagcagaaaccattccagccacagatattacatgaccgtgggtgaaatatgttataaaaactagttctttatccttgaaggggcttctgggaattgaaatgtgcagttgtttatgtgttcattatctgccctttgttcatgggctcgagttggacttctccctgatagcattggtttccacagctgtgccattgaataaaccttgagtttggacctgtt

SEQ ID NO: 137346 - DNA, 1437 bp, Homo sapiens
  Payload ID: 6890
  Gene Symbol: GANC
  Gene Name: glucosidase, alpha
  neutral C
  ENST ID: ENST00000440615
  CDS Start-End: 241-1089
ataatcaagacaaatttgccaaataaatcattgtagaaacgctagtttgggcctgaaaaattccaggagcaagagtcaagatttgtcactccatgagaatctggaggggactcccttcccagaaacttgacgatgaagtactggttgtaattttagaaagacacccaatcggcttttttaaaagatcgcccagggcccttgtcctgagagctgggagctggtcggagtgacagagaagccatggaagcagcagtgaaagaggaaataagtcttgaagatgaagctgtagataaaaacattttcagagactgtaacaagatcgcattttacaggcgtcagaaacagtggctttccaagaagtccacctatcaggcattattggattcagtcacaacagatgaagacagcaccaggttccaaatcatcaatgaagcaagtaaggtcaggtgccaggaccagagcccaacaactctggatgccttcaaaggcaaagaaaccacagtccaggaggagacacaggatctcagcacaagacagcacctggctcaaaaggaagctgaggagcctgataaacaaggacaaattacctgggacatcagcaacgtagctcccaagactgagaactttgaggacctcttggaacaaactccatgctcagcctgtttgcaaggtttcaccagagacaacacttccagcagcttctccgaggatgcaggaatatctctgagcacctctgtgaagttaccccttgcctcttcatctaagcctaatgaaaatgaagctttgcccaaccagccaccttctcagcagataaggcacaactaccgcttattagccagtactgtgtctgcagaaatggccaggaacaggcagctaatttgggaactggccagacaatcagaagcacacctggacaggccagttgtccttggggaacaggccagtgcccagcgtgaggttgccagtattctttgtagaaaatcagtgcttgcaataaaccaactggctgcaactgtagaagggacaattagtgtcctacagcaatttaatgaactattagaccatcctctggatcccgggaggtcttgatcacagctggtagaggtggccactcactgttctatgtcttttaggttaacagttctttacataacagtgaagagtcctggtgcctcaggaaaagcaagatcaacctaccaaggaagagttgatggagtcataattttcctacttaacacccactgcaaatttaaatatgtgttctagggctgtttgttaattctattatggtctttactaattgtgattcccagttctgggtgaataaaaagtttttgttttaatgtaattgtgatcaacactatgcttgaagacatagacaaagctatttctaccaccatgatgtttacaaaatatctggtattttcgcctatatgg

SEQ ID NO: 137347 - DNA, 1052 bp, Homo sapiens
  Payload ID: 6890
  Gene Symbol: GANC
  Gene Name: glucosidase, alpha
  neutral C
  ENST ID: ENST00000562859
  CDS Start-End: 632-1052
gctacggttgccggtcccgcactgaaaaacgacagtggtgacgggtgagctcccagaagcagaagaatgacaggcaacacctgaagccacgcagccgccgccatcttcacagccgtggagtgcctaccgaaagcatttcaccctcttccggttcgtcccgccttcttccggctctgctctaagggcgggattatccgggtcctggaaacgtcgcggagcttgtttgctgtgcggcgtagcggcccctctctcagacagtcgtctgtgcgccgtgagactttggacctactgcgcaggcgtcatcctgttggaacctggactcattgcgtacacgccctcaccgccgcccagtttcggttcctaacaaaagcacgttcctcatcagccacccataatcaagacaaatttgccaaataaatcattgtagaaacgctagtttgggcctgaaaaattccaggagcaagagtcaagatttgtcactccatgagaatctggaggggactcccttcccagaaacttgacgatgaagtactggttgtaattttagaaagacacccaatcggcttttttaaaagatcgcccagggcccttgtcctgagagctgggagctggtcggagtgacagagaagccatggaagcagcagtgaaagaggaaataagtcttgaagatgaagctgtagataaaaacattttcagagactgtaacaagatcgcattttacaggcgtcagaaacagtggctttccaagaagtccacctatcaggcattattggattcagtcacaacagatgaagacagcaccaggttccaaatcatcaatgaagcaagtaaggttcctctcctggctgaaatttatggtatagaaggaaacattttcaggcttaaaattaatgaagagactcctctaaaacccagatttgaagttccggatgtcctcacaagcaagccaagcactgtaaggctgatttcatgctctggggacacaggcagtctgatattggcagatggaaaaggagacctgaagtgccatatcacagcaaacccattcaagg

SEQ ID NO: 137348 - DNA, 676 bp, Homo sapiens
  Payload ID: 6890
  Gene Symbol: GANC
  Gene Name: glucosidase, alpha
  neutral C
  ENST ID: ENST00000562170
  CDS Start-End: 474-676
tcggcagcagctacggttgccggtcccgcactgaaaaacgacagtggtgacgggtgagctcccagaagcagaagaatgacaggcaacacctgaagccacgcagccgccgccatcttcacagccgtggagtgcctaccgaaagcatttcaccctcttccggactcattgcgtacacgccctcaccgccgcccagtttcggttcctaacaaaagcacgttcctcatcagccacccataatcaagacaaatttgccaaataaatcattgtagaaacgctagtttgggcctgaaaaattccaggagcaagagtcaagatttgtcactccatgagaatctggaggggactcccttcccagaaacttgacgatgaagtactggttgtaattttagaaagacacccaatcggcttttttaaaagatcgcccagggcccttgtcctgagagctgggagctggtcggagtgacagagaagccatggaagcagcagtgaaagaggaaataagtcttgaagatgaagctgtagataaaaacattttcagagactgtaacaagatcgcattttacaggcgtcagaaacagtggctttccaagaagtccacctatcaggcattattggattcagtcacaacagatgaagacagcaccaggttccaaatcatcaatgaagcaagtaaggt

SEQ ID NO: 137349 - DNA, 2512 bp, Homo sapiens
  Payload ID: 6890
  Gene Symbol: GANC
  Gene Name: glucosidase, alpha
  neutral C
  ENST ID: ENST00000566442
  CDS Start-End: 702-1775
ttttctgtctcccagccgttaaaggttttaggaccaggcaggcaccccgtgcaggatttggctctctacttccgctcgccccagcccttcatcccttctaagtcaatgtcagactttggggccagaaagtctggaaaagccctaagcctggctgcccaagtggcgtctagtagtgagttctccggtttgggtggtatttaagcaaaggctggaattcggcggtggtggagtacacgcgattcctagactgggtagtgtaacaaccttcaaaggccccttctagccctgaagagtacgatgctgcagtacaatctggctggagacctagcctccagcaaagacccggccggcacttcccacccttaaccgaaaacggagacagagagggactcattgcgtacacgccctcaccgccgcccagtttcggttcctaacaaaagcacgttcctcatcagccacccataatcaagacaaatttgccaaataaatcattgtagaaacgctagtttgggcctgaaaaattccaggagcaagagtcaagatttgtcactccatgagaatctggaggggactcccttcccagaaacttgacgatgaagtactggttgtaattttagaaagacacccaatcggcttttttaaaagatcgcccagggcccttgtcctgagagctgggagctggtcggagtgacagagaagccatggaagcagcagtgaaagaggaaataagtcttgaagatgaagctgtagataaaaacattttcagagactgtaacaagatcgcattttacaggcgtcagaaacagtggctttccaagaagtccacctatcaggcattattggattcagtcacaacagatgaagacagcaccaggttccaaatcatcaatgaagcaagtaaggttcctctcctggctgaaatttatggtatagaaggaaacattttcaggcttaaaattaatgaagagactcctctaaaacccagatttgaagttccggatgtcctcacaagcaagccaagcactgtaaggctgatttcatgctctggggacacaggcagtctgatattggcagatggaaaaggagacctgaagtgccatatcacagcaaacccattcaaggtagacttggtgtctgaagaagaggttgtgattagcataaattccctgggccaattatactttgagcatctacagattcttcacaaacaaagagctgctaaagaaaatgaggaggagacatcagtggacacctctcaggaaaatcaagaagatctgggcctgtgggaagagaaatttggaaaatttgtggatatcaaagctaatggcccttcttctattggtttggatttctccttgcatggatttgagcatctttatgggatcccacaacatgcagaatcacaccaacttaaaaatactggtgatggagatgcttaccgtctttataacctggatgtctatggataccaaatatatgataaaatgggcatttatggttcagtaccttatctcctggcccacaaactgggcagaactataggtattttctggctgaatgcctcggaaacactggtggagatcaatacagagcctgcagtagagtacacactgacccagatgggcccagttgctgctaaacaaaaggtcagatctcgcactcatgtgcactggatgtcagagagtggcatcattgatgtttttctgctgacaggacctacaccttctgatgtcttcaaacagtactcacaccttacagacattggagaaaaatagctctcagtctgaggaagatactgagaaaaggaaagaagttgaaagcatcttgaagaaaaattcagattggatatgggattggacaagttggccagaaaatattccccacaaggagttcctctttaaagcacctgaagcacgtagctacccagcatggaatttaaagcctgatgaggaaagggggcattttctcagcagaatttccaaagggttttgctgctgtctcatctggtggccatgggattggggatctatattggaaggcatctgacaacttctaccagcaccttttgatgaataatttgaatccagctttgtgcgtatagtggggatttctatctgagcttgtgacacagctaactcaggagctgttatggtccttgggtggctgtttcacttgtttttatttgttctgtaaatactgctttcctaatttagtaaaatgaaagaatagacactaaaatcacactgacctatacttatacctatagaatcagttaataagggtatcagactgattaatatctactgtaacaatttggcagtgagttttctttggatattagtataaatatgtaagtatcgttttaatatattagtcatgatatagcattttaaaaattatctgtaacctgaattctgttaaaacactttatattccaaaagaatgaatgacagtgatattaaaatcactacattaaagggtttgcccagaataaatattgtggccttactta

SEQ ID NO: 137350 - DNA, 940 bp, Homo sapiens
  Payload ID: 6890
  Gene Symbol: GANC
  Gene Name: glucosidase, alpha
  neutral C
  ENST ID: ENST00000561871
  CDS Start-End: 912-940
cgttagtgaagtgaatactcaccgacggtatcggaatgtgccatttggaccggtcggcagcagctacggttgccggtcccgcactgaaaaacgacagtggtgacgggtgagctcccagaagcagaagaatgacaggcaacacctgaagccacgcagccgccgccatcttcacagccgtggagtgcctaccgaaagcatttcaccctcttccggttcgtcccgccttcttccggctctgctctaagggcgggattatccgggtcctggaaacgtcgcggagcttgtttgctgtgcggcgtagcggcccctctctcagacagtcgtctgtgcgccgtgagactttggacctactgcgcaggcgtcatcctgttggaacctggtcagctgggttagagagatcgctacatgccagcctggcctgagtcttttctgtctcccagccgttaaaggttttaggaccaggcaggcaccccgtgcaggatttggctctctacttccgctcgccccagcccttcatcccttctaagtcaatgtcagactttggggccagaaagtctggaaaagccctaagcctggctgcccaagtggcgtctagtagactcattgcgtacacgccctcaccgccgcccagtttcggttcctaacaaaagcacgttcctcatcagccacccataatcaagacaaatttgccaaataaatcattgtagaaacgctagtttgggcctgaaaaattccaggagcaagagtcaagatttgtcactccatgagaatctggaggggactcccttcccagaaacttgacgatgaagtactggttgtaattttagaaagacacccaatcggcttttttaaaagatcgcccagggcccttgtcctgagagctgggagctggtcggagtgacagagaagccatggaagcagcagtgaaagaggaaataag

SEQ ID NO: 137351 - DNA, 672 bp, Homo sapiens
  Payload ID: 6890
  Gene Symbol: GANC
  Gene Name: glucosidase, alpha
  neutral C
  ENST ID: ENST00000566690
  CDS Start-End: 362-672
tgagggctctttactaaggttcccctgccaagtagaaacctgaggaaaaggttaaatgcaacaactgctgagtaaatgccctgccagatatttttgctgagaatttctcaagttgattccagcaaagtggtgggttcccattaagaggaactggctccctttccgacttagtcacagagttttattcgtgatctatcatcattccaaacacgtcgttgtctggtatgactataagacatttgctcattgggaaggagggtgtactgtaaagatcccagtagccttggacactattccagtgtttcagcgaggtggaagtgtgataccaataaagacaactgtaggaaaatccacaggctggatgactgaatcctcctatggactccgggttgctctaagcactaagggttcttcagtgggtgagttatatcttgatgatggccattcattccaatacctccaccagaagcaatttttgcacaggaagttttcattctgttccagtgttctgatcaatagttttgctgaccagaggggtcattatcccagcaagtgtgtggtggagaagatcttggtcttaggcttcaggaaggagccatcttctgtgactacccactcatctgatggtaaagatcagcctgtggcttttacgtattgtgccaaaacatccat

SEQ ID NO: 137352 - DNA, 535 bp, Homo sapiens
  Payload ID: 6890
  Gene Symbol: GANC
  Gene Name: glucosidase, alpha
  neutral C
  ENST ID: ENST00000567784
  CDS Start-End: 239-352
aatcaagacaaatttgccaaataaatcattgtagaaacgctagtttgggcctgaaaaattccaggagcaagagtcaagatttgtcactccatgagaatctggaggggactcccttcccagaaacttgacgatgaagtactggttgtaattttagaaagacacccaatcggcttttttaaaagatcgcccagggcccttgtcctgagagctgggagctggtcggagtgacagagaagccatggaagcagcagtgaaagaggaaataagtcttgaagatgaagctgtagataaaaacattttcagagactgtaacaagatcgcattttacaggaagaaaagcgtattatgttaattctgaacaggtatctagagggaagtctacagtgaatgcctggcgtcagaaacagtggctttccaagaagtccacctatcaggcattattggattcagtcacaacagatgaagacagcaccaggttccaaatcatcaatgaagcaagtaaggttcctctcctggctgaaatttatggtataga

SEQ ID NO: 137353 - DNA, 775 bp, Homo sapiens
  Payload ID: 6890
  Gene Symbol: GANC
  Gene Name: glucosidase, alpha
  neutral C
  ENST ID: ENST00000570013
  CDS Start-End: 219-332
ataaatcattgtagaaacgctagtttgggcctgaaaaattccaggagcaagagtcaagatttgtcactccatgagaatctggaggggactcccttcccagaaacttgacgatgaagtactggttgtaattttagaaagacacccaatcggcttttttaaaagatcgcccagggcccttgtcctgagagctgggagctggtcggagtgacagagaagccatggaagcagcagtgaaagaggaaataagtcttgaagatgaagctgtagataaaaacattttcagagactgtaacaagatcgcattttacaggaagaaaagcgtattatgttaattctgaacaggtatctagagggaagtctacagtgaatgcctggcgtcagaaacagtggctttccaagaagtccacctatcaggcattattggattcagtcacaacagatgaagacagcaccaggttccaaatcatcaatgaagcaagtaagcctgtttgcaaggtttcaccagagacaacacttccagcagcttctccgaggatgcaggaatatctctgagcacctctgtgaagttaccccttgcctcttcatctaagcctaatgaaaatgaagctttgcccaaccagccaccttctcagcagataaggcacaactaccgcttattagccagtactgtgtctgcagaaatggccaggaacaggcagctaatttgggaactggccagacaatcagaagcacacctggacaggccagttgtccttggggaacaggccagtgccca

SEQ ID NO: 137354 - DNA, 555 bp, Homo sapiens
  Payload ID: 6890
  Gene Symbol: GANC
  Gene Name: glucosidase, alpha
  neutral C
  ENST ID: ENST00000567596
  CDS Start-End: 215-555
aaagatgaattggtgaggattccaaggaggatcagaatgatttttagtcttcacactttgactagtaaaagtctggtatgactataagacatttgctcattgggaaggagggtgtactgtaaagatcccagtagccttggacactattccagtgtttcagcgaggtggaagtgtgataccaataaagacaactgtaggaaaatccacaggctggatgactgaatcctcctatggactccgggttgctctaagcactaagggttcttcagtgggtgagttatatcttgatgatggccattcattccaatacctccaccagaagcaatttttgcacaggaagttttcattctgttccagtgttctgatcaatagttttgctgaccagaggggtcattatcccagcaagtgtgtggtggagaagatcttggtcttaggcttcaggaaggagccatcttctgtgactacccactcatctgatggtaaagatcagcctgtggcttttacgtattgtgccaaaacatccatcctgagcctggagaagctctcactcaacat

SEQ ID NO: 137355 - DNA, 1672 bp, Homo sapiens
  Payload ID: 6891
  Gene Symbol: GBA2
  Gene Name: glucosidase, beta (bile acid) 2
  ENST ID: ENST00000378088
  CDS Start-End: 384-902
taggctgtgatggaatctgaaatgaagtttgacaaggaccatgatggactcattgaaaatggaggctatgcagaccagacctatgatggatgggtgaccacaggccccaggttagcgggtaggggtttccaggaggcctgaggtgagaaactgggcaacaagggattgtagggctcaagaaagaatgactcattgtctattacacggcatgggagcagctggagctgccagtctgacccccaaacccatgtccctgatcagtgcttactgtggagggctgtggctggcagctgtggctgtgatggtccagatggctgctctgtgtggggcacaggacatccaggataagttttcttctatcctcagccggggccaagaagcctatgagagactgctgtggaatggtgagttcggggagcctaagtagtcttaaggcagctgagaggacaccaggagccttatttttctcttcctcgactccaggccgctattacaactatgacagcagctctcggcctcagtctcgtagtgttatgtctgaccagtgtgctggacagtggttcctgaaggcctgtggcctaggagaaggagacactgaggtgtttcctacccaacatgtggtccgtgctctccaaactatctttgagctgaacgtccaggcctttgcaggaggggccatgggggctgtgaatgggatgcagccccatggtgtccctgataaatccagtgtgcagtctgatgaagtctgggtgggtgtggtctacgggctggcagctaccatgatccaagaggtaatgcactccttttcccatctctccaccatctgtatcctggcccagaaaacttcctcaaccaccaaatttcttcaaggcataacccaatgccatcttgtccgtctataaagcctcccatttttccctggtatgcattccagctcctgccttcaggcttctgtctgtgggtcatagttatctcctccacttgctgggagctccttgaaggcaaagactctactgcctccatctatccagtggaagtggctcttcagagggtgccaagttagtatgtatgactgtcatctctcccaacagggcctgacttgggagggcttccagacagctgaaggctgctaccgtaccgtgtgggagcgcctgggtctggccttccagaccccagaggcatactgccagcagcgagtgttccgctcactggcctacatgcggccactgagcatatgggccatgcagctagccctgcaacagcagcagcacaaaaaggcctcctggccaaaagtcaaacagggcacaggactaaggacagggcctatgtttggaccaaaggaagccatggcaaacctgagcccagagtgagccgtctgaactgtgggagggaagtgctaacagcccagcctccagcctggcctttcctccttcccctctgaacctcctgcaaccctgagccatcaggacaatcataccccttcccttctctccacccaattgtgccagtaaatgggggttgagggtgacctaggcagcattagaatcacttatttatttctttcctcacctgttccctgactgcgtgaaatgttcagggaggtcagttgatttccccaggtacattcatggtgtgacagacacatgggtacaaataaaagacccagaaagcc

SEQ ID NO: 137356 - DNA, 3757 bp, Homo sapiens
  Payload ID: 6891
  Gene Symbol: GBA2
  Gene Name: glucosidase, beta (bile acid) 2
  Uniprot ID: Q9HCG7
  ENST ID: ENST00000378094
  CDS Start-End: 515-3148
gggctcgggtcatcccggcgcccagggtcaccttcccacgggctggcacctgggcgcgggcgctgccccggagccggccggcgggacctggcgcccaatcctgggggacccggtgccgtggcccaggggccgggccgaggtcccgggggcggtgccttgcgggcccgtcccggggcggtgcctggtgggctggccccgcggctcctcccctctctgcgggcccagtcgccctttggccgggcgagctaatcgtcggctcaatgacgacgaggcccgacccttcccgtccaggacctacagagacaaccgaaggagagcccaaggcggcttctttgctgtcgccgcccccactgaagcaagagctccccggctccactgaaacaccagctcatttaagctttccccaacgcccggccctccgggacgatacctaacaacgaccggcgcccgcatctggaataggctggcgagatacttagtatccgagggctcgggacttggcgccatcgaggtcatggggacccaggatccagggaacatgggaaccggcgtcccagcctcggagcagataagctgtgccaaagaggatccacaagtttattgccctgaagagactggcggcaccaaggatgtgcaggttacagactgtaagagtcccgaagacagccgacccccaaaagagacggactgctgcaatccggaggactctgggcagctgatggtttcctatgagggtaaagctatgggctaccaggtgcctccctttggctggcgcatctgtctggctcatgagtttacagagaagaggaaaccctttcaagctaacaacgtctccctaagcaacatgataaagcatataggcatgggcttgaggtacctgcagtggtggtaccggaagacccatgtggaaaagaagacacctttcatcgacatgatcaattctgtacccctaagacagatttatggttgtcccttgggtggcatcgggggaggcactattacccgtggctggagaggccagttctgtcgttggcagcttaaccctggaatgtatcagcaccggacagtcatcgctgaccaattcacagtgtgcctgcgtcgggaagggcagactgtgtaccagcaagtcctgtccctggagcgcccaagtgtcctccgcagctggaactggggcctgtgtgggtactttgctttctaccatgccctctatccccgagcctggactgtctatcagcttcctggccagaatgtcaccctcacctgccgtcagatcacacccatcttgccccatgactaccaggacagcagcctgcctgtaggagtctttgtgtgggatgtggaaaatgaaggggacgaagctctagatgtgtccatcatgttctccatgcggaatggactgggtggtggagacgatgccccagggggtttgtggaatgagcccttctgtctggagcgtagcggggaaactgtccgggggctgctcctgcatcatccaacccttccaaacccctacacgatggctgtggctgcacgagtcacggcagctaccacggtaacccacatcacagcctttgaccctgacagcacggggcagcaggtgtggcaggatctacttcaggatggacagctggactctcccactggccaaagcacccctacgcagaaaggagtaggcattgctggagctgtgtgtgtttccagcaagttgcgacctcgaggccagtgccgcctggagttttcactggcttgggacatgcccaggatcatgtttggagctaaaggccaagtccactacaggcggtatacaaggttctttggccaggatggagatgcagcacctgccctcagccactatgcactgtgccgatacgcagagtgggaagagaggatctcagcttggcagagcccggtattggatgacagatcactgcctgcctggtacaaatctgcgctgttcaatgaactatacttcctggctgatggaggcacagtgtggctggaagttcttgaggactccctaccagaggagctgggcagaaacatgtgtcacctccgccccaccctacgggactacggtcgatttggctaccttgagggccaggagtaccgcatgtacaacacatatgatgtccacttttatgcttcctttgccctcatcatgctctggcccaaacttgagctcagcctacagtatgacatggctctggccactctcagggaggacctgacacggcgacggtacctgatgagtggggtgatggcacctgtgaaaaggaggaacgtcatcccccatgatattggggacccagatgatgaaccatggctccgcgtcaatgcatatttaatccatgatactgctgattggaaggacctgaacctgaagtttgtgctgcaggtttatcgggactattacctcacgggtgatcaaaacttcctgaaggacatgtggcctgtgtgtctagctgtgatggaatctgaaatgaagtttgacaaggaccatgatggactcattgaaaatggaggctatgcagaccagacctatgatggatgggtgaccacaggccccagtgcttactgtggagggctgtggctggcagctgtggctgtgatggtccagatggctgctctgtgtggggcacaggacatccaggataagttttcttctatcctcagccggggccaagaagcctatgagagactgctgtggaatggccgctattacaactatgacagcagctctcggcctcagtctcgtagtgttatgtctgaccagtgtgctggacagtggttcctgaaggcctgtggcctaggagaaggagacactgaggtgtttcctacccaacatgtggtccgtgctctccaaactatctttgagctgaacgtccaggcctttgcaggaggggccatgggggctgtgaatgggatgcagccccatggtgtccctgataaatccagtgtgcagtctgatgaagtctgggtgggtgtggtctacgggctggcagctaccatgatccaagagctcctgccttcaggcttctgtctgtgggtcatagttatctcctccacttgctgggagctccttgaaggcaaagactctactgcctccatctatccagtggaagtggctcttcagagggtgccaagttagtatgtatgactgtcatctctcccaacagggcctgacttgggagggcttccagacagctgaaggctgctaccgtaccgtgtgggagcgcctgggtctggccttccagaccccagaggcatactgccagcagcgagtgttccgctcactggcctacatgcggccactgagcatatgggccatgcagctagccctgcaacagcagcagcacaaaaaggcctcctggccaaaagtcaaacagggcacaggactaaggacagggcctatgtttggaccaaaggaagccatggcaaacctgagcccagagtgagccgtctgaactgtgggagggaagtgctaacagcccagcctccagcctggcctttcctccttcccctctgaacctcctgcaaccctgagccatcaggacaatcataccccttcccttctctccacccaattgtgccagtaaatgggggttgagggtgacctaggcagcattagaatcacttatttatttctttcctcacctgttccctgactgcgtgaaatgttcagggaggtcagttgatttccccaggtacattcatggtgtgacagacacatgggtacaaataaaagacccagaaagcc

SEQ ID NO: 137357 - DNA, 3611 bp, Homo sapiens
  Payload ID: 6891
  Gene Symbol: GBA2
  Gene Name: glucosidase, beta (bile acid) 2
  Uniprot ID: Q9HCG7
  ENST ID: ENST00000378103
  CDS Start-End: 525-3308
agaccggaaagggctcgggtcatcccggcgcccagggtcaccttcccacgggctggcacctgggcgcgggcgctgccccggagccggccggcgggacctggcgcccaatcctgggggacccggtgccgtggcccaggggccgggccgaggtcccgggggcggtgccttgcgggcccgtcccggggcggtgcctggtgggctggccccgcggctcctcccctctctgcgggcccagtcgccctttggccgggcgagctaatcgtcggctcaatgacgacgaggcccgacccttcccgtccaggacctacagagacaaccgaaggagagcccaaggcggcttctttgctgtcgccgcccccactgaagcaagagctccccggctccactgaaacaccagctcatttaagctttccccaacgcccggccctccgggacgatacctaacaacgaccggcgcccgcatctggaataggctggcgagatacttagtatccgagggctcgggacttggcgccatcgaggtcatggggacccaggatccagggaacatgggaaccggcgtcccagcctcggagcagataagctgtgccaaagaggatccacaagtttattgccctgaagagactggcggcaccaaggatgtgcaggttacagactgtaagagtcccgaagacagccgacccccaaaagagacggactgctgcaatccggaggactctgggcagctgatggtttcctatgagggtaaagctatgggctaccaggtgcctccctttggctggcgcatctgtctggctcatgagtttacagagaagaggaaaccctttcaagctaacaacgtctccctaagcaacatgataaagcatataggcatgggcttgaggtacctgcagtggtggtaccggaagacccatgtggaaaagaagacacctttcatcgacatgatcaattctgtacccctaagacagatttatggttgtcccttgggtggcatcgggggaggcactattacccgtggctggagaggccagttctgtcgttggcagcttaaccctggaatgtatcagcaccggacagtcatcgctgaccaattcacagtgtgcctgcgtcgggaagggcagactgtgtaccagcaagtcctgtccctggagcgcccaagtgtcctccgcagctggaactggggcctgtgtgggtactttgctttctaccatgccctctatccccgagcctggactgtctatcagcttcctggccagaatgtcaccctcacctgccgtcagatcacacccatcttgccccatgactaccaggacagcagcctgcctgtaggagtctttgtgtgggatgtggaaaatgaaggggacgaagctctagatgtgtccatcatgttctccatgcggaatggactgggtggtggagacgatgccccagggggtttgtggaatgagcccttctgtctggagcgtagcggggaaactgtccgggggctgctcctgcatcatccaacccttccaaacccctacacgatggctgtggctgcacgagtcacggcagctaccacggtaacccacatcacagcctttgaccctgacagcacggggcagcaggtgtggcaggatctacttcaggatggacagctggactctcccactggccaaagcacccctacgcagaaaggagtaggcattgctggagctgtgtgtgtttccagcaagttgcgacctcgaggccagtgccgcctggagttttcactggcttgggacatgcccaggatcatgtttggagctaaaggccaagtccactacaggcggtatacaaggttctttggccaggatggagatgcagcacctgccctcagccactatgcactgtgccgatacgcagagtgggaagagaggatctcagcttggcagagcccggtattggatgacagatcactgcctgcctggtacaaatctgcgctgttcaatgaactatacttcctggctgatggaggcacagtgtggctggaagttcttgaggactccctaccagaggagctgggcagaaacatgtgtcacctccgccccaccctacgggactacggtcgatttggctaccttgagggccaggagtaccgcatgtacaacacatatgatgtccacttttatgcttcctttgccctcatcatgctctggcccaaacttgagctcagcctacagtatgacatggctctggccactctcagggaggacctgacacggcgacggtacctgatgagtggggtgatggcacctgtgaaaaggaggaacgtcatcccccatgatattggggacccagatgatgaaccatggctccgcgtcaatgcatatttaatccatgatactgctgattggaaggacctgaacctgaagtttgtgctgcaggtttatcgggactattacctcacgggtgatcaaaacttcctgaaggacatgtggcctgtgtgtctagctgtgatggaatctgaaatgaagtttgacaaggaccatgatggactcattgaaaatggaggctatgcagaccagacctatgatggatgggtgaccacaggccccagtgcttactgtggagggctgtggctggcagctgtggctgtgatggtccagatggctgctctgtgtggggcacaggacatccaggataagttttcttctatcctcagccggggccaagaagcctatgagagactgctgtggaatggccgctattacaactatgacagcagctctcggcctcagtctcgtagtgttatgtctgaccagtgtgctggacagtggttcctgaaggcctgtggcctaggagaaggagacactgaggtgtttcctacccaacatgtggtccgtgctctccaaactatctttgagctgaacgtccaggcctttgcaggaggggccatgggggctgtgaatgggatgcagccccatggtgtccctgataaatccagtgtgcagtctgatgaagtctgggtgggtgtggtctacgggctggcagctaccatgatccaagagggcctgacttgggagggcttccagacagctgaaggctgctaccgtaccgtgtgggagcgcctgggtctggccttccagaccccagaggcatactgccagcagcgagtgttccgctcactggcctacatgcggccactgagcatatgggccatgcagctagccctgcaacagcagcagcacaaaaaggcctcctggccaaaagtcaaacagggcacaggactaaggacagggcctatgtttggaccaaaggaagccatggcaaacctgagcccagagtgagccgtctgaactgtgggagggaagtgctaacagcccagcctccagcctggcctttcctccttcccctctgaacctcctgcaaccctgagccatcaggacaatcataccccttcccttctctccacccaattgtgccagtaaatgggggttgagggtgacctaggcagcattagaatcacttatttatttctttcctcacctgttccctgactgcgtgaaatgttcagggaggtcagttgatttccccaggtacattcatggtgtgacagacacatgggtacaaataaaagacccagaaagcca

SEQ ID NO: 137358 - DNA, 2387 bp, Homo sapiens
  Payload ID: 6892
  Gene Symbol: GBA
  Gene Name: glucosidase, beta, acid
  Uniprot ID: P04062
  ENST ID: ENST00000327247
  CDS Start-End: 234-1844
tccccagggctgcttttctcgcggctgcgggtggtcgggctgcatcctgccttcagagtcttactgcgcggggccccagtctccagtcccgcccaggcgcctttgcaggctgcggtgggatttcgttttgcctccggttggggctgctgtttctcttcgccgacgtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagccca

SEQ ID NO: 137359 - DNA, 2276 bp, Homo sapiens
  Payload ID: 6892
  Gene Symbol: GBA
  Gene Name: glucosidase, beta, acid
  Uniprot ID: P04062
  ENST ID: ENST00000368373
  CDS Start-End: 123-1733
gctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagccca

SEQ ID NO: 137360 - DNA, 1817 bp, Homo sapiens
  Payload ID: 6892
  Gene Symbol: GBA
  Gene Name: glucosidase, beta, acid
  Uniprot ID: P04062
  ENST ID: ENST00000428024
  CDS Start-End: 341-1690
ctcttttccaatccaggtcccgccccgactccccagggctgcttttctcgcggctgcgggtggtcgggctgcatcctgccttcagagtcttactgcgcggggccccagtctccagtcccgcccaggcgcctttgcaggctgcggtgggatttcgttttgcctccggttggggctgctgtttctcttcgccgacggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagccca

SEQ ID NO: 137361 - DNA, 2063 bp, Homo sapiens
  Payload ID: 6892
  Gene Symbol: GBA
  Gene Name: glucosidase, beta, acid
  Uniprot ID: P04062
  ENST ID: ENST00000427500
  CDS Start-End: 164-1627
acatgacccatccacatcgggaagccggaattacttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatca

SEQ ID NO: 137362 - DNA, 2387 bp, Homo sapiens
  Payload ID: 6892
  Gene Symbol: GBA
  Gene Name: glucosidase, beta, acid
  ENST ID: ENST00000574670
  CDS Start-End: 234-1844
tccccagggctgcttttctcgcggctgcgggtggtcgggctgcatcctgccttcagagtcttactgcgcggggccccagtctccagtcccgcccaggcgcctttgcaggctgcggtgggatttcgttttgcctccggttggggctgctgtttctcttcgccgacgtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggtgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagccca

SEQ ID NO: 137363 - DNA, 2276 bp, Homo sapiens
  Payload ID: 6892
  Gene Symbol: GBA
  Gene Name: glucosidase, beta, acid
  ENST ID: ENST00000572338
  CDS Start-End: 123-1733
gctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggtgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagccca

SEQ ID NO: 137364 - DNA, 2174 bp, Homo sapiens
  Payload ID: 6892
  Gene Symbol: GBA
  Gene Name: glucosidase, beta, acid
  ENST ID: ENST00000613861
  CDS Start-End: 164-1627
acatgacccatccacatcgggaagccggaattacttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggtgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtca

SEQ ID NO: 137365 - DNA, 2400 bp, Homo sapiens
  Payload ID: 6892
  Gene Symbol: GBA
  Gene Name: glucosidase, beta, acid
  ENST ID: ENST00000618489
  CDS Start-End: 504-1853
ctctctctctctcgctcgctctctcgctctctcgctctctctcgctcgctctctcgctctcgctctctctctctctccggctcgccagcgacacttgttcgttcaacttgaccaatgagacttgaggaagggctctgagtcccgcctctgcatgagtgaccgtctcttttccaatccaggtcccgccccgactccccagggctgcttttctcgcggctgcgggtggtcgggctgcatcctgccttcagagtcttactgcgcggggccccagtctccagtcccgcccaggcgcctttgcaggctgcggtgggatttcgttttgcctccggttggggctgctgtttctcttcgccgacggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggtgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtca

SEQ ID NO: 137366 - DNA, 1232 bp, Homo sapiens
  Payload ID: 6893
  Gene Symbol: GBA3
  Gene Name: glucosidase, beta, acid 3 (gene/pseudogene)
  ENST ID: ENST00000503442
  CDS Start-End: 92-580
cattttctgtttgcacaattgcctggctcctctggccaaagggtgctctgcttctggcagctgaagatcccagtagacagcttcttaaaccatggctttccctgcaggatttggatgggcggcagccactgcagcttatcaagtagaaggaggctgggatgcagatggaaaaggcccttgtgtctgggacacatttactcatcagggaggagagagagttttcaagaaccagactggcgatgtagcttgtggcagctacactctgtgggaggaagatttgaaatgtatcaaacagcttggattgactcattaccgcttctctctttcctggtcacgtctgttacctgatgggacgacaggtttcatcaaccagaaagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaataagccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaatgtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatccataatttttctacataaaaaatcaaagttaaaagtcacattatacagttatgcattcatttcaacaaaatagtgaattgataatctacttgttaatatattcggcccatattttgtgtgtttggacaagtacatctcccttttgcctaatgaacttttgaaaaataataaaataatagaataaattagactttgaatggcagaaaaa

SEQ ID NO: 137367 - DNA, 2018 bp, Homo sapiens
  Payload ID: 6893
  Gene Symbol: GBA3
  Gene Name: glucosidase, beta, acid 3 (gene/pseudogene)
  ENST ID: ENST00000511446
  CDS Start-End: 518-1414
aatgtccctttacacttgcttggtggagataactcttcccttccatttagaagaaaacgtaggaggctgggatgcagatggaaaaggcccttgtgtctgggacacatttactcatcagggaggagagagagttttcaagaaccagactggcgatgtagcttgtggcagctacactctgtgggaggaagatttgaaatgtatcaaacagcttggattgactcattaccgcttctctctttcctggtcacgtctgttacctgatgggacgacaggtttcatcaaccagaaaggaattgattattacaacaagatcatcgatgatttgttaaaaaatggggttactcccattgtgaccctctaccactttgatttgcctcagactttagaagaccaaggaggttggttgtcagaggcaatcattgaatcctttgacaaatatgctcagttttgcttcagtacctttggggatcgtgtcaagcagtggatcaccataaatgaagctaatgttctttctgtgatgtcatatgacttaggtatgtttcctccgggtatccctcactttgggactggaggttatcaggcagctcataatttgattaaggctcatgccagatcctggcacagctatgattccttatttcgaaaaaagcagaaaggtatggtgtctctatcactttttgcggtctggttggaaccagcagatcccaactcagtgtctgaccaggaagctgctaaaagagccatcactttccatctggatttatttgctaaacccatattcatcgatggtgattatcctgaagttgtcaagtctcagattgcctccatgagtcaaaagcaaggctatccatcatcgaggcttccagaattcactgaagaagagaagaaaatgatcaaaggcactgctgatttttttgctgtgcaatattatacaactcgcttaatcaagtaccaggagaacaagaaaggagaactaggtattctccaggatgcggaaattgaattttttccagatccatcttggaaaaatgtggattggatctacgtggtaccatggggagtatgtaaactactgaaatatattaaggatacatataataaccctgtaatttacatcactgagaatgggtttccccagagtgacccagcgcctcttgatgacactcaacgctgggagtatttcagacaaacatttcaggaactgttcaaagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaataagccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaatgtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatccataatttttctacataaaaaatcaaagttaaaagtcacattatacagttatgcattcatttcaacaaaatagtgaattgataatctacttgttaatatattcggcccatattttgtgtgtttggacaagtacatctcccttttgcctaatgaacttttg

SEQ ID NO: 137368 - DNA, 2164 bp, Homo sapiens
  Payload ID: 6893
  Gene Symbol: GBA3
  Gene Name: glucosidase, beta, acid 3 (gene/pseudogene)
  ENST ID: ENST00000508166
  CDS Start-End: 103-1512
gggtgagagctcattttctgtttgcacaattgcctggctcctctggccaaagggtgctctgcttctggcagctgaagatcccagtagacagcttcttaaaccatggctttccctgcaggatttggatgggcggcagccactgcagcttatcaagtagaaggaggctgggatgcagatggaaaaggcccttgtgtctgggacacatttactcatcagggaggagagagagttttcaagaaccagactggcgatgtagcttgtggcagctacactctgtgggaggaagatttgaaatgtatcaaacagcttggattgactcattaccgcttctctctttcctggtcacgtctgttacctgatgggacgacaggtttcatcaaccagaaaggaattgattattacaacaagatcatcgatgatttgttaaaaaatggggttactcccattgtgaccctctaccactttgatttgcctcagactttagaagaccaaggaggttggttgtcagaggcaatcattgaatcctttgacaaatatgctcagttttgcttcagtacctttggggatcgtgtcaagcagtggatcaccataaatgaagctaatgttctttctgtgatgtcatatgacttaggtatgtttcctccgggtatccctcactttgggactggaggttatcaggcagctcataatttgattaaggctcatgccagatcctggcacagctatgattccttatttcgaaaaaagcagaaaggtatggtgtctctatcactttttgcggtctggttggaaccagcagatcccaactcagtgtctgaccaggaagctgctaaaagagccatcactttccatctggatttatttgctaaacccatattcatcgatggtgattatcctgaagttgtcaagtctcagattgcctccatgagtcaaaagcaaggctatccatcatcgaggcttccagaattcactgaagaagagaagaaaatgatcaaaggcactgctgatttttttgctgtgcaatattatacaactcgcttaatcaagtaccaggagaacaagaaaggagaactaggtattctccaggatgcggaaattgaattttttccagatccatcttggaaaaatgtggattggatctacgtggtaccatggggagtatgtaaactactgaaatatattaaggatacatataataaccctgtaatttacatcactgagaatgggtttccccagagtgacccagcgcctcttgatgacactcaacgctgggagtatttcagacaaacatttcaggaactgttcaaagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaataagccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaatgtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatccataatttttctacataaaaaatcaaagttaaaagtcacattatacagttatgcattcatttcaacaaaatagtgaattgataatctacttgttaatatattcggcccatattttgtgtgtttggacaagtacatctcccttttgcctaatgaacttttgaaaaataataaaataatagaataaattagactttgaatggcagaaaaa

SEQ ID NO: 137369 - DNA, 2154 bp, Homo sapiens
  Payload ID: 6893
  Gene Symbol: GBA3
  Gene Name: glucosidase, beta, acid 3 (gene/pseudogene)
  ENST ID: ENST00000610628
  CDS Start-End: 103-1509
gggtgagagctcattttctgtttgcacaattgcctggctcctctggccaaagggtgctctgcttctggcagctgaagatcccagtagacagcttcttaaaccatggctttccctgcaggatttggatgggcggcagccactgcagcttatcaagtagaaggaggctgggatgcagatggaaaaggcccttgtgtctgggacacatttactcatcagggaggagagagagttttcaagaaccagactggcgatgtagcttgtggcagctacactctgtgggaggaagatttgaaatgtatcaaacagcttggattgactcattaccgcttctctctttcctggtcacgtctgttacctgatgggacgacaggtttcatcaaccagaaaggaattgattattacaacaagatcatcgatgatttgttaaaaaatggggttactcccattgtgaccctctaccactttgatttgcctcagactttagaagaccaaggaggttggttgtcagaggcaatcattgaatcctttgacaaatatgctcagttttgcttcagtacctttggggatcgtgtcaagcagtggatcaccataaatgaagctaatgttctttctgtgatgtcatatgacttaggtatgtttcctccgggtatccctcactttgggactggaggttatcaggcagctcataatttgattaaggctcatgccagatcctggcacagctatgattccttatttcgaaaaaagcagaaaggtatggtgtctctatcactttttgcggtctggttggaaccagcagatcccaactcagtgtctgaccaggaagctgctaaaagagccatcactttccatctggatttatttgctaaacccatattcatcgatggtgattatcctgaagttgtcaagtctcagattgcctccatgagtcaaaagcaaggctatccatcatcgaggcttccagaattcactgaagaagagaagaaaatgatcaaaggcactgctgatttttttgctgtgcaatattatacaactcgcttaatcaagtaccaggagaacaagaaaggagaactaggtattctccaggatgcggaaattgaattttttccagatccatcttggaaaaatgtggattggatctacgtggtaccatggggagtatgtaaactactgaaatatattaaggatacatataataaccctgtaatttacatcactgagaatgggtttccccagagtgacccagcgcctcttgatgacactcaacgctgggagtatttcagacaaacatttcaggaactgttcaaagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaagccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaatgtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatccataatttttctacataaaaaatcaaagttaaaagtcacattatacagttatgcattcatttcaacaaaatagtgaattgataatctacttgttaatatattcggcccatattttgtgtgtttggacaagtacatctcccttttgcctaatgaacttttgaaaaataataaaataatagaataaattagactttgaatggc

SEQ ID NO: 137370 - DNA, 1233 bp, Homo sapiens
  Payload ID: 6893
  Gene Symbol: GBA3
  Gene Name: glucosidase, beta, acid 3 (gene/pseudogene)
  ENST ID: ENST00000613293
  CDS Start-End: 103-588
gggtgagagctcattttctgtttgcacaattgcctggctcctctggccaaagggtgctctgcttctggcagctgaagatcccagtagacagcttcttaaaccatggctttccctgcaggatttggatgggcggcagccactgcagcttatcaagtagaaggaggctgggatgcagatggaaaaggcccttgtgtctgggacacatttactcatcagggaggagagagagttttcaagaaccagactggcgatgtagcttgtggcagctacactctgtgggaggaagatttgaaatgtatcaaacagcttggattgactcattaccgcttctctctttcctggtcacgtctgttacctgatgggacgacaggtttcatcaaccagaaagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaagccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaatgtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatccataatttttctacataaaaaatcaaagttaaaagtcacattatacagttatgcattcatttcaacaaaatagtgaattgataatctacttgttaatatattcggcccatattttgtgtgtttggacaagtacatctcccttttgcctaatgaacttttgaaaaataataaaataatagaataaattagactttgaatggc

SEQ ID NO: 137371 - DNA, 1937 bp, Homo sapiens
  Payload ID: 6894
  Gene Symbol: GXYLT1
  Gene Name: glucoside xylosyltransferase 1
  Uniprot ID: Q4G148
  ENST ID: ENST00000280876
  CDS Start-End: 67-1296
tccctccgctccagttcgtcggggcgggcgcggcggcggcggcgaaggaggagcgcggccggggcgatgcggcgctacctgcgcgtcgtggtgctgtgtgtggcctgcggcttctgctcgctcctttacgctttcagccagctcgccgtgtccctggaagaaggaacgggcggcggtggcgggaagccgcaggccgcggtggcttcctggctcgcgggcggcggacgcggcgccgtgagaggcgccggcgtcgcgggccccgcagcgcatcccggcgtgtcggacaggtacagtctgaaaatacagcctgttgagaaaatgcatctagctgtagttgcctgtggtgaaagactggaagaaactatgaccatgttgaagtcagctatcattttcagcatcaaacctcttcaattccatatttttgctgaagatcagctacatcatagctttaaaggcagacttgacaactggtcatttctacaaacatttaattatacgttataccccataacctttccaagtgagaatgcagcagagtggaaaaaactctttaaaccatgtgcttcgcagagattgttcttgccgttaatcctgaaagaagttgactcactattgtatgtcgacactgatatcctttttttacgaccagttgatgatatttggtctttactaaagaaatttaattccacacaaattgctgcaatggcaccagaacatgaggaacctcgaataggatggtataatcgctttgctaggcatccatattatggaaaaactggagtaaactctggagttatgttgatgaacatgactcgaatgagaaggaagtatttcaagaatgatatgacaactgtacgactacaatggggagatatacttatgccattgcttaaaaaatacaaactaaacatcacatggggtgatcaagatctattgaatatcgtgttttttcataatccagaaagcctttttgtttttccgtgtcaatggaattatcgaccagatcattgtatatatggaagcaattgccaagaagcagaagaaggaggaatctttattcttcatgggaacagaggtgtttaccatgacgataagcaaccagcatttagagctgtttatgaagcactgagaaattgttcttttgaagatgacaacatccgttccttattaaaacctttagaactggaactacaaaaaacagtgcatacatactgtggaaaaatttacaaaatatttatcaaacaactagcaaaaagtgtaagagatcgttatgccagatcaccaaaggaaaagtgattcttggtgactgcttaatcaaatggatgaaaacaaagaatcagaagataagtgtgaaggaatcgtcttggatgaagtattcaggaaggaattactcatctccagaataattttttttttcctaaagaagttaagtaagcagtattttcaggtaatgaagaataagttaaaatcttgggcctcaacattgaacattttttatctctgatgttttgtaatgttacttgctatcattccagtattgatgaaaatactattgaatgggtttaacctgcagacttctgttgactcatactctcaagagtggtaggggtgtgtagatggagaaaatgtacctcaaacagtgccaacactcaagactgtgagtagagcaataattttatgtcagcactaacctcactttaaaagtgtgagaaaaaagtttgtttacaggagcagaaacaggtctgttgtttctgaagaaatgtgatgtaactgatgtaaccattgacaatctatgtgtgcctttatacatttcatctctgttttaaaatatttttatgacaatcatgtttaaaattatttttagattacaagtaagctgcatgttaaaaattgagctgtgtaaggtagaggaaaaatagtgaaaactttgggatttt

SEQ ID NO: 137372 - DNA, 7497 bp, Homo sapiens
  Payload ID: 6894
  Gene Symbol: GXYLT1
  Gene Name: glucoside xylosyltransferase 1
  Uniprot ID: Q4G148
  ENST ID: ENST00000398675
  CDS Start-End: 234-1556
gcggcagaggcggtgtccaggcttccgggcgggtagtccttcggctccggagccgcgactgcgctcgcctaggtggtgggcggggagggaaggaagggagcgggcgcaaggcggcggcggcggctgcgggtgaggaacttgttgcgcccgcggctgcgcggtgcccctccctccgctccagttcgtcggggcgggcgcggcggcggcggcgaaggaggagcgcggccggggcgatgcggcgctacctgcgcgtcgtggtgctgtgtgtggcctgcggcttctgctcgctcctttacgctttcagccagctcgccgtgtccctggaagaaggaacgggcggcggtggcgggaagccgcaggccgcggtggcttcctggctcgcgggcggcggacgcggcgccgtgagaggcgccggcgtcgcgggccccgcagcgcatcccggcgtgtcggacaggtgtaaagatttctctctgtgttactggaatccctattggatgctgccctctgatgtttgtggaatgaactgcttttgggaagcggcttttaggtacagtctgaaaatacagcctgttgagaaaatgcatctagctgtagttgcctgtggtgaaagactggaagaaactatgaccatgttgaagtcagctatcattttcagcatcaaacctcttcaattccatatttttgctgaagatcagctacatcatagctttaaaggcagacttgacaactggtcatttctacaaacatttaattatacgttataccccataacctttccaagtgagaatgcagcagagtggaaaaaactctttaaaccatgtgcttcgcagagattgttcttgccgttaatcctgaaagaagttgactcactattgtatgtcgacactgatatcctttttttacgaccagttgatgatatttggtctttactaaagaaatttaattccacacaaattgctgcaatggcaccagaacatgaggaacctcgaataggatggtataatcgctttgctaggcatccatattatggaaaaactggagtaaactctggagttatgttgatgaacatgactcgaatgagaaggaagtatttcaagaatgatatgacaactgtacgactacaatggggagatatacttatgccattgcttaaaaaatacaaactaaacatcacatggggtgatcaagatctattgaatatcgtgttttttcataatccagaaagcctttttgtttttccgtgtcaatggaattatcgaccagatcattgtatatatggaagcaattgccaagaagcagaagaaggaggaatctttattcttcatgggaacagaggtgtttaccatgacgataagcaaccagcatttagagctgtttatgaagcactgagaaattgttcttttgaagatgacaacatccgttccttattaaaacctttagaactggaactacaaaaaacagtgcatacatactgtggaaaaatttacaaaatatttatcaaacaactagcaaaaagtgtaagagatcgttatgccagatcaccaaaggaaaagtgattcttggtgactgcttaatcaaatggatgaaaacaaagaatcagaagataagtgtgaaggaatcgtcttggatgaagtattcaggaaggaattactcatctccagaataattttttttttcctaaagaagttaagtaagcagtattttcaggtaatgaagaataagttaaaatcttgggcctcaacattgaacattttttatctctgatgttttgtaatgttacttgctatcattccagtattgatgaaaatactattgaatgggtttaacctgcagacttctgttgactcatactctcaagagtggtaggggtgtgtagatggagaaaatgtacctcaaacagtgccaacactcaagactgtgagtagagcaataattttatgtcagcactaacctcactttaaaagtgtgagaaaaaagtttgtttacaggagcagaaacaggtctgttgtttctgaagaaatgtgatgtaactgatgtaaccattgacaatctatgtgtgcctttatacatttcatctctgttttaaaatatttttatgacaatcatgtttaaaattatttttagattacaagtaagctgcatgttaaaaattgagctgtgtaaggtagaggaaaaatagtgaaaactttgggattttaatctgtgtgtgcgtgtttgtgtgtgagagagagtgagaaatgtagtgtttcattttgtatgcattaaactgtcttgccaaaactcagatctaagattgttaaatagatatttggggaatttttttttaatcactttaaatgaaaaacgtcagctttactgggcattctggaagcaaaatatattatgctgatggtaaagtgagaaccttaagagtatactcatgatggtggaaagtgtgatggaccaaaatgcataagctatatacttcctgtgagtagtaattttagttacaatggagtagaaaaatatggtccatttaaacttgtcttctacctcataacggccttgcaagatacttttgaagaagcaaatgtctagagccttactttaagtaagttaaacaacttaagtggatgatttggaataagattgttacatccagctgtagaaaatgtggttttaattgggttgatgtgcatttttgaatatcacctaagacagttaatttttttaaatcttgagaaattacttctttggcattcttgacctgttagctaatataactatagattctgaatacttagcatatactatgctggggcacatatcttattttaccaacaatatgattatctatatggttatcttctttttctccctgatattttaatgctcaagtagaaaatggaaaatcatgaaggaaaaatacaacctgtgaaaattgtggcagttagctttgtgaagacacagtgacctctgtggagacatggaatatgcagaaagagatggttagtacagttgttctgtcgtctgcagttcagtcagggacaaattgagagaggaaagtttaagcagggtgcattagaagttgataaccagtccagcattcttagaacagatgggtttagagaacacgagttgtagttccttggcagaatgccatggtgaatataagaaactgtgaaattgagcttactgagtagaaaatgagaatactaaaaatgtgaagtttggagggtatgtattagatcatttctaatggtcctcaaataatgatcattgcctgcctgactatgtaagattcttgttgggagcttaagaatagattcctgagctaggcctttggagactctggcatgctgtgtctaggagggagtctgtaaaacaatttttaatgaagaaatttaaaaattacacaaaactagaatagtgcattggtactcaacatccagatctgacacttatcactatcttaccatgtttgcttcatttgtcatttttttgtttgcttaagtatcttaaaatcccatacattgtgttatttcactgctgtgaacactttgggtagataccacgatatcacacctaacagaggcagcagcagtccttcggcttcatctcatagccagtccttaagcaaatttccctgattatctcaaaaatcatcttctagttggtttgttagaatcaacagaatataagtcacatgatgatttcgtttttaacaatcacctcagatgactttgatgttagctactttgagaaccactggaaattattttgccaacttgaaagttcaagttaggataccacaattcttggcacgtttggtggattataaatgtgattttgaaatattagaggaagcatttggggttaatgacaggatatgaatttatattagtaagtttgataagataaaatttcctcagtgaacggagaatctcagccccatgggctctaattgattgggacttgtgtagagcgtggtcacagtttaatccaactggactgtatgctgtggtctcactcatgttgtggcttatttacactgtcacacacactacattgtggatcagttggaaggttcttcatctggtttatttagacctgacctaattgatcattttaccataaattgaattatagtgaaaactgtcttttgggtactgtttctacctaaaattaaaggtatcacaaaatatgtataataatttttaaatgaattttctgaatttatctttagacaaggtaattcttttgaattctaaagaaatgcagttcttggagttgatgagaggttaaattatagatggacaacttagagaacgtattccatcttcatataaatggtctttcataaaacatagtgtatctatgcagtttatataaactacatgatttattatttgagtctatgtattctgacctcagaactatctctgggctacagtattaccaaagtgggatgcctttaaaatgcagtcaaacttcatttgtatgaagtagaaaagaacttgggaaacctttaaaaatatatattgtgatttatgctttaagaaaatgcatacttttttctaatgaagagtagttcataatatataagggttttaaggccctgaaataacattagtgcttactcattgctctctcatcttgcctccagtcagatgttattggtatagtgaaaagaagaccagattttgaactagatctggattctctttttagtaactcaggcatgttatttacccttctctgtgccttaggtttttaagtacaatcagtgtacccttcaaacctcacaagatgaaactcagaagagataatggatttggaagcattttgcgtggcttatattatgccacgccagtgttactgttgaagttctgttttgttcgttgttttctgtacagagcgttcagtttactcaggctgaatgttttctgacatatatctccagtatgaatttgtttatgtaaggaagagtttttcaggaagagaaagtagagaagaaaagaatgatgtaactaaatcaaaaaagaaggaaaagagaggaagtgagaaaaggggtgaggaaagagaaaggagtaagaatggggatggcaaagggcagagtaagagaaaagatggaatgagtgtatggaaaattgagaagtagagatggagagaaatggtgtggaaacatttactttttgagttgtagccctcacactacatcagtttgcttgcctgggctctctggggtcaggaaaggtgctgacttccatggaatggggcagcagggcctgctgtatttggtttgttagtactagagttgtttcccaatcaccctactcactgatcatttagtgccaattcaacattttatgtcttttttttttagtggatcccagtttgtgagctaggacctgtggaaatacaagtatcttcctttttaactttattgttttagccatcccaagtgttagactgcaagactaactacatattccccagtggaggttggaagtggaggggactgcttcattaggtctgaagggggccaaggaatgtgttgcagcagttttcgcagatgatactgacgagaggccaggtttgggaatcactgccctgccttggatggcaaattaagcaataaattacacctatttattcctcagttgggatactttcagttgaaccattctgagtagatttaagagaacaaaagacagcagaaataccttaaaagatattattggctgtcttatttttcagatatttgtatttaataaataccttagtagtagtcagaacctctttgagatgtttttagaaagaccactgatttgttttttaaaataatttttttggttccttagagtagagaagaaaagtaggggtgcaatatgtcaggtgtggggccagttatccatttattaaatgcaatttcaagtgtcttaaaaacaataattgccttattgcattttaatatttaataaagtagattaaataaagatttgtattataacagttattcttttatccattgccaaagcaacccttttttgcctattaaaatctggctaaactgttctgatgttgtttcttaattcattaaacatgaaactaggttttacaaactaaattatataaagacagaagtctaaaaatggtaccagaaaatttttttttaaaaaattaatgtgttattcaaatatccagcaattaaagactcatgagaaaaacagaatagcatattagatgtaacagtttaaaatggattgcaaatcaatgtcagacttaaatagaaaatatttattatcacctcatttctaccaataatttcagatgtttaatgggactttgaaaagataggaaaaaatagaaatgaaaatttatctcacctttaatactgtgaatactatttggagggtccctggtcagacatttaaatatcaaacttaagaactgacatggagcctttgattagtttatatacaggatctgaatatttacacacatagcacactatagcaacctcttgtaaaaaatcatgaagatagaattcaacagtgtatattctattaaaaagtaaattggctgggtgtggtggctcatgcatgtaatcccagcactttgggaggccgaggcaggaggatcgcttgagcccaagagtttgagaccagcctaggtgacaaagtgagaccccatctctacaaaaaaattaaaaaattatccagatgtggtggtgtttgcctgcggtcctagctacacaggaagttgaggcaggaggattgcttgagtgcaagagtttgaggctgcagagagccaagattgcaccattgcactccagcctgggtgacagagcgagaccctgtctcaaaaaataaaggaaattggctttgactatgaaaaacagccattttcaacctttttataaaacctcttcagggaatattggaatattatttttgtcaggcaaaaataatccagggcttgagcattgctgtagaatatgttatctgttcaaaacttagcagagcacgcatgcatcacatgcattgtcatcagtatttgagagctgaaccaatggtttttgatggttgccgtaacagaagatctgtgaagaggatggtggtttgcacctgttcctgaagtcaaactggaaaaggttgcaggtatttcaattttctcaatcattttgcataaatgtattaatattttgagtagtaatagttctaaacctgcaggaaggcatcattgtatactgtggtatgtagagaatactactcttacactgctctttatcttaaaatgttttggtatactgtgaatattttcctctaagtatttggtgtattttgacagttattaaaggagaatataaaattaaagattctggtctaaactaagaataatggaaagttgcttcgtcctgccttagaggagttttcagttcatcctcttcttgagaaactatgtgttgctgttactaaataaacatttactcaataaacgttttatttcctcaaa

SEQ ID NO: 137373 - DNA, 3260 bp, Homo sapiens
  Payload ID: 6895
  Gene Symbol: GXYLT2
  Gene Name: glucoside xylosyltransferase 2
  Uniprot ID: A0PJZ3
  ENST ID: ENST00000389617
  CDS Start-End: 162-1493
gtcgccgccgccgccggccgcccgccggccgccacgaccccagtccccggcgggcgggcggaggaggcgaccgccgcgcgctgctgcactcatcctgccgccgccgcgatgcgcagaggggccgagccgcctgggggccgccgccgccgccgcgccgcaccatgaagctccgcagcaaggcggcggcgctgctcttgctcgcgctggccgcgctgctgctggcgctgctgtccctgcgcgctggccgcgctgagcccccagcgctgcccgcgcgccccgcgtccgccccgcagcgccaccccgcgcctgtccccgcgcgctggccggggccgggcgccctccccggggccagcccgggagttcggaggcgccggcccccgcgtccgcgcccccgagcgggccgccggggcgctgcgagactggagaagttggcgaggaggcctggagaacccaggagtttccaagctgtgctgccacccgagctctggatccacctggctgtggtggcctgtggcaatcggctggaggagacgctggtcatgctcaaatcagctgtgctttttagccacaggaagatccaattccacatcttcactgaagactctctgaagcccgagtttgataagcagttacgccagtggcctgactcatatacaaagaagtttgagcacagaatctaccccatcacattttctgttggaaaccctcaggagtggaagaaattgttcaaaccctgtgctgcccagagactctttcttccggtgattttaaaggatgtggactcacttctctacgtggacaccgatgtcctctttctgagacctgttgatgacatctggaagcttctgaggctgtttaattccacccagcttgcagccatggcccctgagcacgaaatccccaagattggctggtacagccgctttgctaggcatcctttctatggctctgcaggagttaattcaggagtcatgttaatgaatttaactcggataagaagtacccagttcaagaacagcatgattccaacaggcctggcttgggaggacatgttgtaccctctgtaccagaagtacaagaatgccatcacgtggggagaccaggatttattaaatattattttttatttcaacccagagtgtctctatgtattcccctgccagtggaactaccgtcccgatcactgcatgtacggaagcaactgcagagaggctgagcatgaaggtgtgtctgttctgcatggaaaccgaggcgtctaccatgacgataagcaaccaacgttcagagcactctatgaagcaatacgggattttccctttcaagacaatctctttcaatccatgtattacccccttcagctgaagtttttggagactgtgcacactttatgtggacgaatcccgcaagtttttctgaagcaaattgagaaaacaatgaaaagggcttatgagaaacacgtcatcatccatgttggccccaaccagatgcactgaatattttgtcttgttgcaagtcaattaggtgtcttgtgaccaaggaaatactaatctctaagctgcctgggtctttttgtgtgaatatttaatggtgctccatgactgttgagttttaaaaacctcgttaaattttgccaaatcagttgcccccaaaagggaatatgcttttccttatttttttttctaaaatgctatttatctctaaggaaaaaaaaaaaagactattactcatttaacattgtttaagcaggttgagctagctgtgaaaatagcttttgtgagccttctaattcctaaacgtctgagaccatttcagtggcacctgaggtgttatattgatctagcattcctgagactctttctatgcaactgactcccccacacccgtgttataaaagtaatacacacttttgaaacagagagacacacttgtagagcatatgggtcaagggctcaacatcaagattagattagccataatcctattgaccagtggaaaagattgtttccattttaaagcagttccttacaaccttttttctctacttttgcattttccactctaacacacatctaaaacaggtaatctcagtaaaagctggcctttttgctgagatttttatgtgggagactaaaatattagatgagatgattatgtgtacagaattttatttaaaatacatctgagagaatcattcagatacttgggtagtgttaaaggatgaagcatgtatctgggggtatttcttctttttctttctttctttttttttttttttttttttttgagacggaatctcactctgtagcccaggctagaatgcagtggcaggatctcggctcactgcagcttccacctcctgggttcaagtgattctcatgcctcagcctccccagtagctgggattacaagtgtgtgccaccacacccggctaatttttgtatttttagtagagacacggttttaccatgttggccaggctggtcttgatctccagacctcaagtgatctgcctgcctcagcctcccaaagtgctgggattacaagtgtgagccactgcactcagccaatctgggagtatttctaaagaaaaaaattactttgatttgtggaggactaaatcataatacatttctatgcaacaatagcttctgagaggaaattcaggaatgtttgtgtttaccacagacaaaaacatttgatctgttaatcatcagtagctgtggtcatctctctttcttaaactcttgggcaatgggtggaaatcagagaccaacttcaaatttaatgtgtaaaaaacaaatagttcagctgcttctattggtaagaaaattcaacttcctaccagccttagaaaggtctctttaaacaatttctttccccctagggttacctagctggtccatacaggttttatcacctcactgcaaggaggaagttgaatattctgttccccacggggatctggcttaatccctagttgctcatatagttggtatcagcatagcaatattttgcataatgctttatttttctcaaatgactattgcatagatgatcttgatatttgcaacagcctagtggatttggtagggtcctgaatcatctctataaggcaaacaaggaaattgtaacacaaagaaataaacatattgaatataattgctattctgtaagacatacagtctgtgtaagatgtatcttatttacagagacatttttgaaaattaaaatattaaatactttttgttatatagagacaa

SEQ ID NO: 137374 - DNA, 754 bp, Homo sapiens
  Payload ID: 6895
  Gene Symbol: GXYLT2
  Gene Name: glucoside xylosyltransferase 2
  ENST ID: ENST00000498315
  CDS Start-End: 449-754
ctccacagcccttgtgtcagctgtcgaagtttagcaatactatttccaaacatgggccagtaggcagccagcaggcaccagacagctgagtgctggcagaaaaagcctcagacacctatagcagtccaaacagtgactcatcctgctattgccaggataaatatgggaataaatggtatttttctctaagcaggaagaattgtcaaaatgcttatcactttataaaatataacagattgtgcctgatcatgttttgaaatgttctaaccattcactcgccggttttttgttgtttttacttttttgagtttagtaatagctttcacttgttttccctctttctaggaggcctggagaacccaggagtttccaagctgtgctgccacccgagctctggatccacctggctgtggtggcctgtggcaatcggctggaggagacgctggtcatgctcaaatcagctgtgctttttagccacaggaagatccaattccacatcttcactgaagactctctgaagcccgagtttgataagcagttacgccagtggcctgactcatatacaaagaagtttgagcacagaatctaccccatcacattttctgttggaaaccctcaggagtggaagaaattgttcaaaccctgtgctgcccagagactctttcttccggtgattttaaaggatgtggactcacttctctacgtggacaccgatgtcctctttctgagacctgttgatgacatctggaagctt

SEQ ID NO: 137375 - DNA, 494 bp, Homo sapiens
  Payload ID: 6895
  Gene Symbol: GXYLT2
  Gene Name: glucoside xylosyltransferase 2
  ENST ID: ENST00000491839
  CDS Start-End: 1-494
atggcccctgagcacgaaatccccaagattggctggtacagccgctttgctaggcatcctttctatggctctgcaggagttaattcaggagtcatgttaatgaatttaactcggataagaagtacccagttcaagaacagcatgattccaacaggcctggcttgggaggacatgttgtaccctctgtaccagaagtacaagaatgccatcacgtggggagaccaggatttattaaatattattttttatttcaacccagagtgtctctatgtattcccctgccagtggaactaccgtcccgatcactgcatgtacggaagcaactgcagagaggctgagcatgaaggtgtgtctgttctgcatggaaaccgaggcgtctaccatgacgataagcaaccaacgttcagagcactctatgaagcaatacgggatattttgagaagagggggaaaaaggaagtttgtcctgtcctggatcagtttctttgtcatgta

SEQ ID NO: 137376 - DNA, 5037 bp, Homo sapiens
  Payload ID: 6896
  Gene Symbol: GLCE
  Gene Name: glucuronic acid epimerase
  Uniprot ID: O94923
  ENST ID: ENST00000261858
  CDS Start-End: 229-2082
cacacaagcgcttccttgccgagaggctggagctgcggcaccgcaggcctgagccaccccttctctgctgtctccttctcttcctcagggctcccgtgtctgctcgccctccgacgctgctcaggaatttgacaagaaactgaagttttgattcagatatattttgaattgaaaccagagatgttctagagtttagattctttcatttgattaaggtatggtctgaatatgcgttgcttggcagctcgggtcaactataagactttgattattatctgcgcactcttcactttggtcacagtacttttgtggaataagtgttccagtgacaaagcaatccagtttccacggcgttcgagtagtggcttcagagtggatgggtttgaaaaaagagcagcagcatctgagagtaacaactatatgaaccacgtggccaaacaacagtctgaggaagcattccctcaggaacagcagaaagcaccccctgttgttgggggcttcaatagcaatgtgggaagtaaggtgttagggctcaaatatgaagaaattgactgtctcataaatgatgaacacacaattaaagggagacgagaggggaacgaagtctttcttccattcacttgggttgagaaatattttgatgtttatggaaaggtggttcagtatgatggctatgatcggtttgaattctctcatagctattccaaagtctatgcacagagagccccctatcaccccgatggtgtgtttatgtcttttgaaggctacaatgtggaagtccgagacagagtcaagtgcataagtggggttgaaggtgtgccattatctacacaatggggacctcaaggctatttctatccaatccagattgcacagtatggattaagtcattacagcaagaatctaactgagaaacctcctcacatagaggtatatgaaacagcagaagacagagacaaaaacaagcctaatgactggactgtgccaaagggctgctttatggcgaatgtggctgataagtctagattcaccaatgtcaaacagtttattgcaccagaaaccagtgaaggtgtatccttgcaactgggaaacacaaaagattttattatttcatttgacctcaagttcttgacaaatggaagtgtgtccgtggttctagagaccacagaaaagaatcagctcttcactatacattatgtctcaaatgctcagctaattgcttttaaagaaagagatatatactatggcattgggcccagaacttcatggagcacagttaccagggacctggtcactgacctcaggaaaggagtgggtctttcaaacacaaaagctgtcaagccaaccaaaataatgcccaagaaggtggttaggttgattgcaaaaggtaagggattcctcgacaacattaccatctctaccacagcccacatggctgcattttttgctgctagtgattggctagtaaggaaccaggatgagaaaggtggctggccaattatggtgacccgtaagttaggggaagggttcaagtctttagagccaggatggtattctgccatggcccaagggcaagccatttctacattagtcagggcctatctgttaacaaaagaccatatattcctcaattcagctttaagggcaacagccccttataagtttctatctgagcagcatggagttaaagctgtgtttatgaataaacatgactggtatgaagaatatccaaccacacctagctcttttgttttaaatggctttatgtattctttaattgggctgtatgacttaaaagaaactgcaggggaaaaactcggaaaagaagcaaggtccttgtatgagcgtggcatggaatctcttaaagccatgctgcccttgtatgacactggctcaggaaccatctatgacctccgtcacttcatgcttggcatcgctcctaacctggctcgctgggactatcataccacccacatcaatcagttgcagctactcagtaccattgatgagtccccagtcttcaaagaatttgtcaagaggtggaaaagctaccttaaaggcagcagggcaaagcacaactagagctcacaaccaaaactgcacttcagcctctgctgtacacagaaactacaggctctgtctcaggagagcataggcacattttaaaaggttatgtactaggtttttgtggattctatcaaagtgataagtgatccttaaaaccagccttctaaaataattgcattccatgggttgggtatttagaaatgtaggtggcatttagaacacaatgtttaatcaatgggctgaacaaagatgcttcactttgccttgcccatcaccctatacagtttcgcagatagtctagtcactctatgtgagaaagataatggtaagtagttgctactggccaactgtctagcacttacctgaaaacttagtatggagctcttttaaaatgtgattatttatatttatgttgaaagcggactttaaaaaaaataatgtgctgtaacacagtaaatatgtacttgtagcctggatagcagactgtgttcaactttttaaaaagatgtttcctttctaaagattaatttcttgggagcaaatgagtatttgttgcatttgttcaatttgttgtatatggtgaatatttaattatggttttcttgaaacgtgtaaattaaaaacacaatcagtgttcaggcttcagttatataatgtaagcacaactaaaatgaaacttgttgactgcacaagaaattacaaaaatgtttctgttttgaaacttgatctacaatcagtaaaagtttgataatcagtatatcccttcccaacccccattgtgacagtttctttttgtcactgtctagaattttgtattttatttcagactataccttggagttttgtatattttgagagagatatttttgggacattattttggaaacttattacaaatctaaatttggaaaggagctagtagctttaaggccaccaccatattttacttttttaggatttttccccctttaaataaaaatattagatcaaatactatatgcaagaaatcatagcaaagtttttttttcctaccaagatcattcttgatcatcagcttcccaaactagtaagtctgtgcatcattgggtgtttttttttaatttaattttaaattatcccagctattagatagaagggatgttactgcacttatgtgtaatcagatctttatttaggtatacatatcctcctataccgcacataaatagatttcagagcccccatacaatgggcagtgtctgctatagggcttcaggcattaaataaaaccgagggttgttgattttgctgtgacagtacactaaatcaatactatatcttatacagtttgaaaatatgataccctacactttcaggggaccgagtctgacaaacacaatacatttatctgtgacctatatcaagtacacatttaggagccaggtaggttacctgcttacacactatattttaattgaattcaaactatcaagcactacttagaaactggaaaacatatatatgttagcatcaaagggggcagaagcaaagaagatacagatctgcactgaagacattagactggccatagaaaagtaagcttgaactcccaattgatgtgaccacactcttcttaattttgttcacagtaaaaacacttttttgagttattaggcttacccctagcttttgacctttgcatttcatatatgttagatgtctcagcaagaatatctggtctcccctaatttttattcccagtgccgatgttcaaaataaactttctccagtctgggaaccttttttacttccccatatttgttattatttagaatggttcatacgtctgctttgtttgcatactggtcttcagattatgagactcgatgataacagtatggtactgcttctgtgacaaatatcgtgccttaacaatgtggctgtccttttccactgaagaaggaaagacgttttgatctagaaatagcgttgtgatttccttgctgttggttttacactgccttccacattgcaacagcaagttgatttcttgtgatcccagaattttctaagaggatgagttgaatctatagcagcattgtcagtacagaccagtggttctcaaactttaaaatgcctcagcatcacttgggagcttattgaaatgcagatcccagagtcagtaaatctgcctgtgaagtatgatagtctgcatttgtaatgagcattcaagtgattctgatgcaggtgagctgggggcatacagggaggaacactgccctggactatccattgcatttttgcctctaaacaactacagaattttctagggttttaaattatgtaaaatgtttacttattctgagcttagagagaatggggagggtatttttaaattttattgttttatttctttaagtttttctttgctttaagattataggtattaggtttgtttttgtttttccacttatcttgagttcactttgatgttaaatctattgctacttcagttgtaaaaccagccaaaagtttctggatgaaggtcaagtttgaccttttaggagttattgtacataaaggcttcatccacgaaccatccagcgcacagaagcaagtgcaaaaatgacacaagcacaactctccagacgtggctccttctcctttctcagtgcagactctcactgaaagctgctattttcatcctccttgtggttgcttttcttgtttctcttccattgtacatgtgggttatataccatatgttaaatatgcaataaagtgtttacaggatgcccttctgaagggtagtcctttgtaaagctgtacagactttgcagtttaagcacaatgtgcacatgttagttttatatacagcaaaacttgattttttgcagatggaaaggtattttgtttctatacaaagtaaatggattgtttgtgcttaatgtaaagccgctttataaaactgtaaaataaagtttttttctt

SEQ ID NO: 137377 - DNA, 4840 bp, Homo sapiens
  Payload ID: 6896
  Gene Symbol: GLCE
  Gene Name: glucuronic acid epimerase
  ENST ID: ENST00000559420
  CDS Start-End: 206-1867
gtatggtctgaatatgcgttgcttggcagctcgggtcaactataagactttgattattatctgcgcactcttcactttggtcacagtacttttgtggaataagtgttccagtgacaaagcaatccagtttccacggcgttcgagtagtggcttcagagtggatgggtttgaaaaaagagcagcagcatctgagagtaacaactatatgaaccacgtggccaaacaacagtctgaggaagcattccctcaggaacagcagaaagcaccccctgttgttgggggcttcaatagcaatgtgggaagtaaggtgttagggctcaaatatgaagaaattgactgtctcataaatgatgaacacacaattaaagggagacgagaggggaacgaagtctttcttccattcacttgggttgagaaatattttgatgtttatggaaaggtggttcagtatgatggctatgatcggtttgaattctctcatagctattccaaagtctatgcacagagagccccctatcaccccgatggtgtgtttatgtcttttgaaggctacaatgtggaagtccgagacagagtcaagtgcataagtggggttgaaggtgtgccattatctacacaatggggacctcaaggctatttctatccaatccagattgcacagtatggattaagtcattacagcaagaatctaactgagaaacctcctcacatagaggtatatgaaacagcagaagacagagacaaaaacaagcctaatgactggactgtgccaaagggctgctttatggcgaatgtggctgataagtctagattcaccaatgtcaaacagtttattgcaccagaaaccagtgaaggtgtatccttgcaactgggaaacacaaaagattttattatttcatttgacctcaagttcttgacaaatggaagtgtgtccgtggttctagagaccacagaaaagaatcagctcttcactatacattatgtctcaaatgctcagctaattgcttttaaagaaagagatatatactatggcattgggcccagaacttcatggagcacagttaccagggacctggtcactgacctcaggaaaggagtgggtctttcaaacacaaaagctgtcaagccaaccaaaataatgcccaagaaggtggttaggttgattgcaaaaggtaagggattcctcgacaacattaccatctctaccacagcccacatggctgcattttttgctgctagtgattggctagtaaggaaccaggatgagaaaggtggctggccaattatggtgacccgtaagttaggggaagggttcaagtctttagagccaggatggtattctgccatggcccaagggcaagccatttctacattagtcagggcctatctgttaacaaaagaccatatattcctcaattcagctttaagggcaacagccccttataagtttctatctgagcagcatggagttaaagctgtgtttatgaataaacatgactggtatgaagaatatccaaccacacctagctcttttgttttaaatggctttatgtattctttaattgggctgtatgacttaaaagaaactgcaggggaaaaactcggaaaagaagcaaggtccttgtatgagcgtggcatggaatctcttaaagccatgctgcccttgtatgacactggctcaggaaccatctatgacctccgtcacttcatgcttggcatcgctcctaacctggctcgctgggactatcataccacccacatcaatcagttgcagctactcagtaccattgatgagtccccagtcttcaaagaatttgtcaagaggtggaaaagctaccttaaaggcagcagggcaaagcacaactagagctcacaaccaaaactgcacttcagcctctgctgtacacagaaactacaggctctgtctcaggagagcataggcacattttaaaaggttatgtactaggtttttgtggattctatcaaagtgataagtgatccttaaaaccagccttctaaaataattgcattccatgggttgggtatttagaaatgtaggtggcatttagaacacaatgtttaatcaatgggctgaacaaagatgcttcactttgccttgcccatcaccctatacagtttcgcagatagtctagtcactctatgtgagaaagataatggtaagtagttgctactggccaactgtctagcacttacctgaaaacttagtatggagctcttttaaaatgtgattatttatatttatgttgaaagcggactttaaaaaaaataatgtgctgtaacacagtaaatatgtacttgtagcctggatagcagactgtgttcaactttttaaaaagatgtttcctttctaaagattaatttcttgggagcaaatgagtatttgttgcatttgttcaatttgttgtatatggtgaatatttaattatggttttcttgaaacgtgtaaattaaaaacacaatcagtgttcaggcttcagttatataatgtaagcacaactaaaatgaaacttgttgactgcacaagaaattacaaaaatgtttctgttttgaaacttgatctacaatcagtaaaagtttgataatcagtatatcccttcccaacccccattgtgacagtttctttttgtcactgtctagaattttgtattttatttcagactataccttggagttttgtatattttgagagagatatttttgggacattattttggaaacttattacaaatctaaatttggaaaggagctagtagctttaaggccaccaccatattttacttttttaggatttttccccctttaaataaaaatattagatcaaatactatatgcaagaaatcatagcaaagtttttttttcctaccaagatcattcttgatcatcagcttcccaaactagtaagtctgtgcatcattgggtgtttttttttaatttaattttaaattatcccagctattagatagaagggatgttactgcacttatgtgtaatcagatctttatttaggtatacatatcctcctataccgcacataaatagatttcagagcccccatacaatgggcagtgtctgctatagggcttcaggcattaaataaaaccgagggttgttgattttgctgtgacagtacactaaatcaatactatatcttatacagtttgaaaatatgataccctacactttcaggggaccgagtctgacaaacacaatacatttatctgtgacctatatcaagtacacatttaggagccaggtaggttacctgcttacacactatattttaattgaattcaaactatcaagcactacttagaaactggaaaacatatatatgttagcatcaaagggggcagaagcaaagaagatacagatctgcactgaagacattagactggccatagaaaagtaagcttgaactcccaattgatgtgaccacactcttcttaattttgttcacagtaaaaacacttttttgagttattaggcttacccctagcttttgacctttgcatttcatatatgttagatgtctcagcaagaatatctggtctcccctaatttttattcccagtgccgatgttcaaaataaactttctccagtctgggaaccttttttacttccccatatttgttattatttagaatggttcatacgtctgctttgtttgcatactggtcttcagattatgagactcgatgataacagtatggtactgcttctgtgacaaatatcgtgccttaacaatgtggctgtccttttccactgaagaaggaaagacgttttgatctagaaatagcgttgtgatttccttgctgttggttttacactgccttccacattgcaacagcaagttgatttcttgtgatcccagaattttctaagaggatgagttgaatctatagcagcattgtcagtacagaccagtggttctcaaactttaaaatgcctcagcatcacttgggagcttattgaaatgcagatcccagagtcagtaaatctgcctgtgaagtatgatagtctgcatttgtaatgagcattcaagtgattctgatgcaggtgagctgggggcatacagggaggaacactgccctggactatccattgcatttttgcctctaaacaactacagaattttctagggttttaaattatgtaaaatgtttacttattctgagcttagagagaatggggagggtatttttaaattttattgttttatttctttaagtttttctttgctttaagattataggtattaggtttgtttttgtttttccacttatcttgagttcactttgatgttaaatctattgctacttcagttgtaaaaccagccaaaagtttctggatgaaggtcaagtttgaccttttaggagttattgtacataaaggcttcatccacgaaccatccagcgcacagaagcaagtgcaaaaatgacacaagcacaactctccagacgtggctccttctcctttctcagtgcagactctcactgaaagctgctattttcatcctccttgtggttgcttttcttgtttctcttccattgtacatgtgggttatataccatatgttaaatatgcaataaagtgtttacaggatgcccttctgaagggtagtcctttgtaaagctgtacagactttgcagtttaagcacaatgtgcacatgttagttttatatacagcaaaacttgattttttgcagatggaaaggtattttgtttctatacaaagtaaatggattgtttgtgcttaatgtaaagccgctttataaaactgtaaaataaagtttttttcttaaaaagaatatacctgga

SEQ ID NO: 137378 - DNA, 2300 bp, Homo sapiens
  Payload ID: 6897
  Gene Symbol: GUSB
  Gene Name: glucuronidase, beta
  Uniprot ID: P08236
  ENST ID: ENST00000304895
  CDS Start-End: 132-2087
gtcctcaaccaagatggcgcggatggcttcaggcgcatcacgacaccggcgcgtcacgcgacccgccctacgggcacctcccgcgcttttcttagcgccgcagacggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatacgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcctgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtggctactgaaaa

SEQ ID NO: 137379 - DNA, 1742 bp, Homo sapiens
  Payload ID: 6897
  Gene Symbol: GUSB
  Gene Name: glucuronidase, beta
  Uniprot ID: P08236
  ENST ID: ENST00000421103
  CDS Start-End: 29-1546
acggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatacgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcctgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatg

SEQ ID NO: 137380 - DNA, 1983 bp, Homo sapiens
  Payload ID: 6897
  Gene Symbol: GUSB
  Gene Name: glucuronidase, beta
  ENST ID: ENST00000447929
  CDS Start-End: 14-448
gggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtggtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatacgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcctgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaa

SEQ ID NO: 137381 - DNA, 1859 bp, Homo sapiens
  Payload ID: 6897
  Gene Symbol: GUSB
  Gene Name: glucuronidase, beta
  ENST ID: ENST00000430730
  CDS Start-End: 33-437
gcagacggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatacgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcctgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaa

SEQ ID NO: 137382 - DNA, 933 bp, Homo sapiens
  Payload ID: 6897
  Gene Symbol: GUSB
  Gene Name: glucuronidase, beta
  ENST ID: ENST00000446111
  CDS Start-End: 31-465
agacggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtggtatcccaagggttactttgtccagaacacatattttgactttttcaactacgctggactgcagcggtctgtacttctgtacacgacacccaccacctacatcgatgacatcaccgtcaccaccagcgtggagcaagacagtggtgagggcttctgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtaatggtggtttgggacatgcctaagggaggtcttttgcccccatgtggtgaccctggcttcagcaggagcccaagacaggtggatgggcaggcatggtcctctgagctttctgatgtttctcacccttggtgggaggcccattttcttttttttttttttt

SEQ ID NO: 137383 - DNA, 1029 bp, Homo sapiens
  Payload ID: 6898
  Gene Symbol: GAD1
  Gene Name: glutamate decarboxylase 1 (brain, 67kDa)
  Uniprot ID: Q99259
  ENST ID: ENST00000344257
  CDS Start-End: 201-875
gagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaattcctcctggaagtggtggacatactcctcaactatgtccgcaagacatttgatcgctccaccaaggtgctggactttcatcacccacaccagttgctggaaggcatggagggcttcaacttggagctctctgaccaccccgagtccctggagcagatcctggttgactgcagagacaccttgaagtatggggttcgcacaggtcatcctcgatttttcaaccagctctccactggattggatattattggcctagctggagaatggctgacatcaacggccaataccaacatgccatcagacatgagggagtgttggttgctacggtgatggggctcagagcagaaccaaagcatgattgtgacctccagaggtgatggtaactgcacacatggtttccaagggtcttcctcctaaatttccaggggcctcccaaggaaaatggacatattctttttggaaataaaatacttctaccaacata

SEQ ID NO: 137384 - DNA, 3604 bp, Homo sapiens
  Payload ID: 6898
  Gene Symbol: GAD1
  Gene Name: glutamate decarboxylase 1 (brain, 67kDa)
  Uniprot ID: Q99259
  ENST ID: ENST00000358196
  CDS Start-End: 551-2335
gaattcttcgtaggaattatcttttccctcctctcacccgacagcctgcctatttccaaaggaaaaaaaaaaagcgtgttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaattcctcctggaagtggtggacatactcctcaactatgtccgcaagacatttgatcgctccaccaaggtgctggactttcatcacccacaccagttgctggaaggcatggagggcttcaacttggagctctctgaccaccccgagtccctggagcagatcctggttgactgcagagacaccttgaagtatggggttcgcacaggtcatcctcgatttttcaaccagctctccactggattggatattattggcctagctggagaatggctgacatcaacggccaataccaacatgtttacatatgaaattgcaccagtgtttgtcctcatggaacaaataacacttaagaagatgagagagatagttggatggtcaagtaaagatggtgatgggatattttctcctgggggcgccatatccaacatgtacagcatcatggctgctcgctacaagtacttcccggaagttaagacaaagggcatggcggctgtgcctaaactggtcctcttcacctcagaacagagtcactattccataaagaaagctggggctgcacttggctttggaactgacaatgtgattttgataaagtgcaatgaaagggggaaaataattccagctgattttgaggcaaaaattcttgaagccaaacagaagggatatgttcccttttatgtcaatgcaactgctggcacgactgtttatggagcttttgatccgatacaagagattgcagatatatgtgagaaatataacctttggttgcatgtcgatgctgcctggggaggtgggctgctcatgtccaggaagcaccgccataaactcaacggcatagaaagggccaactcagtcacctggaaccctcacaagatgatgggcgtgctgttgcagtgctctgccattctcgtcaaggaaaagggtatactccaaggatgcaaccagatgtgtgcaggatacctcttccagccagacaagcagtatgatgtctcctacgacaccggggacaaggcaattcagtgtggccgccacgtggatatcttcaagttctggctgatgtggaaagcaaagggcacagtgggatttgaaaaccagatcaacaaatgcctggaactggctgaatacctctatgccaagattaaaaacagagaagaatttgagatggttttcaatggcgagcctgagcacacaaacgtctgtttttggtatattccacaaagcctcaggggtgtgccagacagccctcaacgacgggaaaagctacacaaggtggctccaaaaatcaaagccctgatgatggagtcaggtacgaccatggttggctaccagccccaaggggacaaggccaacttcttccggatggtcatctccaacccagccgctacccagtctgacattgacttcctcattgaggagatagaaagactgggccaggatctgtaatcatccttcgcagaacatgagtttatgggaatgccttttccctctggcactccagaacaaacctctatatgttgctgaaacacacaggccatttcattgagggaaaacataatatcttgaagaatattgttaaaaccttacttaaagcttgtttgttctagttagcaggaaatagtgttctttttaaaaagttgcacattaggaacagagtatatatgtacagttatacatacctctctctatatatacatgtatagtgagtgtggcttagtaatagatcacggcatgtttcccgctccaagagaattcactttaccttcagcagttaccgaggagctaaacatgctgccaaccagcttgtccaacaactccaggaaaactgtttttcaaaacgccatgtcctaggggccgagggaaatgctgttggtgagaatcgacctcactgtcagcgtttctccacctgaagtgatgatggatgagaaaaaacaccaccaaatgacaagtcacaccctccccattagtatcctgttaggggaaaatagtagcagagtcattgttacaggtgtactatggctgtatttttagagattaatttgtgtagattgtgtaaattcctgttgtctgaccttggtggtgggagggggagactatgtgtcatgatttcaatgattgtttaattgtaggtcaatgaaatatttgcttatttatattcagagatgtaccatgttaaagaggcgtcttgtattttcttcccatttgtaatgtatcttatttatatatgaagtaagttctgaaaactgtttatggtattttcgtgcatttgtgagccaaagagaaaagattaaaattagtgagatttgtatttatattagagtgcccttaaaataatgatttaagcattttactgtctgtaagagaattctaagattgtacataaagtcatatatatggaaatcctgttacttaaatagcatctgctcttctcttacgctctctgtctggctgtacgtctggtgttctcaatgcttttctagcaactgttggataataactagatctcctgtaattttgtagtagttgatgaccaatctctgtgactcgcttagctgaaacctaaggcaacatttccgaagaccttctgaagatctcagataaagtgaccaggctcacaactgtttttgaagaagggaaattcacactgtgcgttttagagtatgcaagaagaatataaataaataaaaatattctccatggagaatttgaacaaaa

SEQ ID NO: 137385 - DNA, 1252 bp, Homo sapiens
  Payload ID: 6898
  Gene Symbol: GAD1
  Gene Name: glutamate decarboxylase 1 (brain, 67kDa)
  Uniprot ID: Q99259
  ENST ID: ENST00000375272
  CDS Start-End: 427-1101
gcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgaggtggcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaattcctcctggaagtggtggacatactcctcaactatgtccgcaagacatttgatcgctccaccaaggtgctggactttcatcacccacaccagttgctggaaggcatggagggcttcaacttggagctctctgaccaccccgagtccctggagcagatcctggttgactgcagagacaccttgaagtatggggttcgcacaggtcatcctcgatttttcaaccagctctccactggattggatattattggcctagctggagaatggctgacatcaacggccaataccaacatgccatcagacatgagggagtgttggttgctacggtgatggggctcagagcagaaccaaagcatgattgtgacctccagaggtgatggtaactgcacacatggtttccaagggtcttcctcctaaatttccaggggcctcccaaggaaaatggacatattctttttggaaataaaatacttctaccaac

SEQ ID NO: 137386 - DNA, 556 bp, Homo sapiens
  Payload ID: 6898
  Gene Symbol: GAD1
  Gene Name: glutamate decarboxylase 1 (brain, 67kDa)
  ENST ID: ENST00000456864
  CDS Start-End: 194-556
aggtagaggagaaacgctgaaaccggaccgaaacctcgccctaggcttagcgatggctaaaaaccggctgggataagagggaggcaagcaacattccgactcgctgctttctggctgtctggagtgcaagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaattcctcctggaagtggtg

SEQ ID NO: 137387 - DNA, 639 bp, Homo sapiens
  Payload ID: 6898
  Gene Symbol: GAD1
  Gene Name: glutamate decarboxylase 1 (brain, 67kDa)
  ENST ID: ENST00000445006
  CDS Start-End: 528-639
gtgcgtgtcatcaaccttcaaacgtgattaatcaggaggccttcttttcccatcaccaagggggccaaagcgaggagcgagcgcatagcaaaagggacgcggggtccttttctctgccggtggcactgggtagctgtggccagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatg

SEQ ID NO: 137388 - DNA, 529 bp, Homo sapiens
  Payload ID: 6898
  Gene Symbol: GAD1
  Gene Name: glutamate decarboxylase 1 (brain, 67kDa)
  ENST ID: ENST00000454603
  CDS Start-End: 274-529
attttcctgcctcccagctgtgagtgttgtgtggtctgttgggatgggggtgtggatttagctatgatccttcaaaaaagtccagaataattcagggaactatctttaaagtacaaaaacagcaaatggaccttagctccgacttaagcagaatgaaaggttaagtaacgcttcccccagttctcgtctcgggagacagacgtttaaccgcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatg

SEQ ID NO: 137389 - DNA, 1780 bp, Homo sapiens
  Payload ID: 6898
  Gene Symbol: GAD1
  Gene Name: glutamate decarboxylase 1 (brain, 67kDa)
  ENST ID: ENST00000414527
  CDS Start-End: 75-776
gcagagccgagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaattcctcctggaagtggtggacatactcctcaactatgtccgcaagacatttgatcgctccaccaaggtgctggactttcatcacccacaccagttgctggaaggcatggagggcttcaacttggagctctctgaccaccccgagtccctggagcagatcctggttgactgcagagacaccttgaagtatggggttcgcacaggtcatcctcgatttttcaaccagctctccactggattggatattattggcctagctggagaatggctgacatcaacggccaataccaacatggggcgccatatccaacatgtacagcatcatggctgctcgctacaagtacttcccggaagttaagacaaagggcatggcggctgtgcctaaactggtcctcttcacctcagaacagagtcactattccataaagaaagctggggctgcacttggctttggaactgacaatgtgattttgataaagtgcaatgaaagggggaaaataattccagctgattttgaggcaaaaattcttgaagccaaacagaagggatatgttcccttttatgtcaatgcaactgctggcacgactgtttatggagcttttgatccgatacaagagattgcagatatatgtgagaaatataacctttggttgcatgtcgatgctgcctggggaggtgggctgctcatgtccaggaagcaccgccataaactcaacggcatagaaagggccaactcagtcacctggaaccctcacaagatgatgggcgtgctgttgcagtgctctgccattctcgtcaaggaaaagggtatactccaaggatgcaaccagatgtgtgcaggatacctcttccagccagacaagcagtatgatgtctcctacgacaccggggacaaggcaattcagtgtggccgccacgtggatatcttcaagttctggctgatgtggaaagcaaagggcacagtgggatttgaaaaccagatcaacaaatgcctggaactggctgaatacctctatgccaagattaaaaacagagaagaatttgagatggttttcaatggcgagcctgagcacacaaacgtctgtttttggtatattccacaaagcctcaggggtgtgccagacagccctcaacgacgggaaaagctacacaaggtggctccaaaaatcaaagccctgatgatggagtcaggtacgaccatggttggctaccagccccaaggggacaaggccaacttcttccggatggtcatctccaacccagccgctacccagtctgacattgacttcctcattgaggagatagaaagactgggccaggatctgtaatcatccttcgcagaacatgagtttatgggaatgc

SEQ ID NO: 137390 - DNA, 571 bp, Homo sapiens
  Payload ID: 6898
  Gene Symbol: GAD1
  Gene Name: glutamate decarboxylase 1 (brain, 67kDa)
  ENST ID: ENST00000455008
  CDS Start-End: 226-571
ttcttatccctgccctccggattcacgccccggggaagcacggaggctgaggctctagttgaagtggggcaagagcgattttcccttgagcttccatgctgcgagcgcctgtccctccaaagggcgcctgggcagcagcagccgaaggcgctactaggaacgcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaat

SEQ ID NO: 137391 - DNA, 3988 bp, Homo sapiens
  Payload ID: 6898
  Gene Symbol: GAD1
  Gene Name: glutamate decarboxylase 1 (brain, 67kDa)
  Uniprot ID: Q99259
  ENST ID: ENST00000493875
  CDS Start-End: 823-2100
ggtagaggagaaacgctgaaaccggaccgaaacctcgccctaggcttagcgatggctaaaaaccggctgggataagagggaggcaagcaacattccgactcgctgctttctggctgtctggagtgcaaggtgactgtggttcttctctggccaagtccgagggagaacgtaaagatatgggcctttttccccctctcaccttgtctcaccaaagtccctagtccccggagcagttagcctctttctttccagggaattagccagacacaacaacgggaaccagacaccgaaccagacatgcccgccccgtgcgccctccccccgctggcccacacgccggctgctgagtgcccaatggggcttgtagcggctcggctggaaaatcgctcactgagcgctcccctgtgctcctagcctagtcccccacacccttgcgtcttgtactggccttggacccccaccccgaccccgaccccgcctcgtctcggcgcttcactccaggtcgcgccgatgcaccgccagactcgagagcggcccagggctacgctccctgcgccccagtaccggagctagcgcgcacgtctcctccgctgcccccacccctgcgcacccctaccaggcaggctcgctgcctttcctccctcttgtctctccagagccggatcttcaaggggagcctccgtgcccccggctgctcagtccctccggtgtgcaggaccccggaagtcctccccgcacagctctcgcttctctttgcagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaattcctcctggaagtggtggacatactcctcaactatgtccgcaagacatttgatcgctccaccaaggtgctggactttcatcacccacaccagttgctggaaggcatggagggcttcaacttggagctctctgaccaccccgagtccctggagcagatcctggttgactgcagagacaccttgaagtatggggttcgcacaggtcatcctcgatttttcaaccagctctccactggattggatattattggcctagctggagaatggctgacatcaacggccaataccaacatgtttacatatgaaattgcaccagtgtttgtcctcatggaacaaataacacttaagaagatgagagagatagttggatggtcaagtaaagatggtgatgggatattttctcctgggggcgccatatccaacatgtacagcatcatggctgctcgctacaagtacttcccggaagttaagacaaagggcatggcggctgtgcctaaactggtcctcttcacctcagaacagagtcactattccataaagaaagctggggctgcacttggctttggaactgacaatgtgattttgataaagtgcaatgaaagggggaaaataattccagctgattttgaggcaaaaattcttgaagccaaacagaagggatatgttcccttttatgtcaatgcaactgctggcacgactgtttatggagcttttgatccgatacaagagattgcagatatatgtgagaaatataacctttggttgcatgtcgatggatttaacttctcacaattggccaataggatcatctgccttgctactgaactaatgactaacaaaggctgtgtcacgtggcatcccaactattcagtaaacatgcatcatggctgcctggggaggtgggctgctcatgtccaggaagcaccgccataaactcaacggcatagaaagggccaactcagtcacctggaaccctcacaagatgatgggcgtgctgttgcagtgctctgccattctcgtcaaggaaaagggtatactccaaggatgcaaccagatgtgtgcaggatacctcttccagccagacaagcagtatgatgtctcctacgacaccggggacaaggcaattcagtgtggccgccacgtggatatcttcaagttctggctgatgtggaaagcaaagggcacagtgggatttgaaaaccagatcaacaaatgcctggaactggctgaatacctctatgccaagattaaaaacagagaagaatttgagatggttttcaatggcgagcctgagcacacaaacgtctgtttttggtatattccacaaagcctcaggggtgtgccagacagccctcaacgacgggaaaagctacacaaggtggctccaaaaatcaaagccctgatgatggagtcaggtacgaccatggttggctaccagccccaaggggacaaggccaacttcttccggatggtcatctccaacccagccgctacccagtctgacattgacttcctcattgaggagatagaaagactgggccaggatctgtaatcatccttcgcagaacatgagtttatgggaatgccttttccctctggcactccagaacaaacctctatatgttgctgaaacacacaggccatttcattgagggaaaacataatatcttgaagaatattgttaaaaccttacttaaagcttgtttgttctagttagcaggaaatagtgttctttttaaaaagttgcacattaggaacagagtatatatgtacagttatacatacctctctctatatatacatgtatagtgagtgtggcttagtaatagatcacggcatgtttcccgctccaagagaattcactttaccttcagcagttaccgaggagctaaacatgctgccaaccagcttgtccaacaactccaggaaaactgtttttcaaaacgccatgtcctaggggccgagggaaatgctgttggtgagaatcgacctcactgtcagcgtttctccacctgaagtgatgatggatgagaaaaaacaccaccaaatgacaagtcacaccctccccattagtatcctgttaggggaaaatagtagcagagtcattgttacaggtgtactatggctgtatttttagagattaatttgtgtagattgtgtaaattcctgttgtctgaccttggtggtgggagggggagactatgtgtcatgatttcaatgattgtttaattgtaggtcaatgaaatatttgcttatttatattcagagatgtaccatgttaaagaggcgtcttgtattttcttcccatttgtaatgtatcttatttatatatgaagtaagttctgaaaactgtttatggtattttcgtgcatttgtgagccaaagagaaaagattaaaattagtgagatttgtatttatattagagtgcccttaaaataatgatttaagcattttactgtctgtaagagaattctaagattgtacataaagtcatatatatggaaatcctgttacttaaatagcatctgctcttctcttacgctctctgtctggctgtacgtctggtgttctcaatgcttttctagcaactgttggataataactagatctcctgtaattttgtagtagttgatgaccaatctctgtgactcgcttagctgaaacctaaggcaacatttccgaagaccttctgaagatctcagataaagtgaccaggctcacaactgtttttgaagaagggaaattcacactgtgcgttttagagtatgcaagaagaatataaataaataaaaatattctccatggagaatttgaacaaaa

SEQ ID NO: 137392 - DNA, 461 bp, Homo sapiens
  Payload ID: 6898
  Gene Symbol: GAD1
  Gene Name: glutamate decarboxylase 1 (brain, 67kDa)
  ENST ID: ENST00000486850
  CDS Start-End: 1-254
cgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagaggtagcccctgccccactcccgccccatgctagccagtagatttcttatttgagtttcttgactttttcctgcaattttacttcttttatcaagaaatgtcattattctctctgaacccacatgaaactgcttttgtgactttgggggaatataattgactccctccctccctgctggccaggtctccatcattttggaaactggatgaaggcagtcaataaaagtcaactctaaagaca

SEQ ID NO: 137393 - DNA, 3700 bp, Homo sapiens
  Payload ID: 6898
  Gene Symbol: GAD1
  Gene Name: glutamate decarboxylase 1 (brain, 67kDa)
  Uniprot ID: Q99259
  ENST ID: ENST00000625689
  CDS Start-End: 551-1828
gaattcttcgtaggaattatcttttccctcctctcacccgacagcctgcctatttccaaaggaaaaaaaaaaagcgtgttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaattcctcctggaagtggtggacatactcctcaactatgtccgcaagacatttgatcgctccaccaaggtgctggactttcatcacccacaccagttgctggaaggcatggagggcttcaacttggagctctctgaccaccccgagtccctggagcagatcctggttgactgcagagacaccttgaagtatggggttcgcacaggtcatcctcgatttttcaaccagctctccactggattggatattattggcctagctggagaatggctgacatcaacggccaataccaacatgtttacatatgaaattgcaccagtgtttgtcctcatggaacaaataacacttaagaagatgagagagatagttggatggtcaagtaaagatggtgatgggatattttctcctgggggcgccatatccaacatgtacagcatcatggctgctcgctacaagtacttcccggaagttaagacaaagggcatggcggctgtgcctaaactggtcctcttcacctcagaacagagtcactattccataaagaaagctggggctgcacttggctttggaactgacaatgtgattttgataaagtgcaatgaaagggggaaaataattccagctgattttgaggcaaaaattcttgaagccaaacagaagggatatgttcccttttatgtcaatgcaactgctggcacgactgtttatggagcttttgatccgatacaagagattgcagatatatgtgagaaatataacctttggttgcatgtcgatggatttaacttctcacaattggccaataggatcatctgccttgctactgaactaatgactaacaaaggctgtgtcacgtggcatcccaactattcagtaaacatgcatcatggctgcctggggaggtgggctgctcatgtccaggaagcaccgccataaactcaacggcatagaaagggccaactcagtcacctggaaccctcacaagatgatgggcgtgctgttgcagtgctctgccattctcgtcaaggaaaagggtatactccaaggatgcaaccagatgtgtgcaggatacctcttccagccagacaagcagtatgatgtctcctacgacaccggggacaaggcaattcagtgtggccgccacgtggatatcttcaagttctggctgatgtggaaagcaaagggcacagtgggatttgaaaaccagatcaacaaatgcctggaactggctgaatacctctatgccaagattaaaaacagagaagaatttgagatggttttcaatggcgagcctgagcacacaaacgtctgtttttggtatattccacaaagcctcaggggtgtgccagacagccctcaacgacgggaaaagctacacaaggtggctccaaaaatcaaagccctgatgatggagtcaggtacgaccatggttggctaccagccccaaggggacaaggccaacttcttccggatggtcatctccaacccagccgctacccagtctgacattgacttcctcattgaggagatagaaagactgggccaggatctgtaatcatccttcgcagaacatgagtttatgggaatgccttttccctctggcactccagaacaaacctctatatgttgctgaaacacacaggccatttcattgagggaaaacataatatcttgaagaatattgttaaaaccttacttaaagcttgtttgttctagttagcaggaaatagtgttctttttaaaaagttgcacattaggaacagagtatatatgtacagttatacatacctctctctatatatacatgtatagtgagtgtggcttagtaatagatcacggcatgtttcccgctccaagagaattcactttaccttcagcagttaccgaggagctaaacatgctgccaaccagcttgtccaacaactccaggaaaactgtttttcaaaacgccatgtcctaggggccgagggaaatgctgttggtgagaatcgacctcactgtcagcgtttctccacctgaagtgatgatggatgagaaaaaacaccaccaaatgacaagtcacaccctccccattagtatcctgttaggggaaaatagtagcagagtcattgttacaggtgtactatggctgtatttttagagattaatttgtgtagattgtgtaaattcctgttgtctgaccttggtggtgggagggggagactatgtgtcatgatttcaatgattgtttaattgtaggtcaatgaaatatttgcttatttatattcagagatgtaccatgttaaagaggcgtcttgtattttcttcccatttgtaatgtatcttatttatatatgaagtaagttctgaaaactgtttatggtattttcgtgcatttgtgagccaaagagaaaagattaaaattagtgagatttgtatttatattagagtgcccttaaaataatgatttaagcattttactgtctgtaagagaattctaagattgtacataaagtcatatatatggaaatcctgttacttaaatagcatctgctcttctcttacgctctctgtctggctgtacgtctggtgttctcaatgcttttctagcaactgttggataataactagatctcctgtaattttgtagtagttgatgaccaatctctgtgactcgcttagctgaaacctaaggcaacatttccgaagaccttctgaagatctcagataaagtgaccaggctcacaactgtttttgaagaagggaaattcacactgtgcgttttagagtatgcaagaagaatataaataaataaaaatattctccatg

SEQ ID NO: 137394 - DNA, 2462 bp, Homo sapiens
  Payload ID: 6899
  Gene Symbol: GAD2
  Gene Name: glutamate decarboxylase 2 (pancreatic islets and brain, 65kDa)
  Uniprot ID: Q05329
  ENST ID: ENST00000259271
  CDS Start-End: 146-1903
acccgccctcgccgctcggccccgccggtccccgcgcggtgccctcctcccgccacacgggcacgcacgcgcgcgcagggccaagcccgaggcagctcgcccgcagctcgcactcgcaggcgacctgctccagtctccaaagccgatggcatctccgggctctggcttttggtctttcgggtcggaagatggctctggggattccgagaatcccggcacagcgcgagcctggtgccaagtggctcagaagttcacgggcggcatcggaaacaaactgtgcgccctgctctacggagacgccgagaagccggcggagagcggcgggagccaacccccgcgggccgccgcccggaaggccgcctgcgcctgcgaccagaagccctgcagctgctccaaagtggatgtcaactacgcgtttctccatgcaacagacctgctgccggcgtgtgatggagaaaggcccactttggcgtttctgcaagatgttatgaacattttacttcagtatgtggtgaaaagtttcgatagatcaaccaaagtgattgatttccattatcctaatgagcttctccaagaatataattgggaattggcagaccaaccacaaaatttggaggaaattttgatgcattgccaaacaactctaaaatatgcaattaaaacagggcatcctagatacttcaatcaactttctactggtttggatatggttggattagcagcagactggctgacatcaacagcaaatactaacatgttcacctatgaaattgctccagtatttgtgcttttggaatatgtcacactaaagaaaatgagagaaatcattggctggccagggggctctggcgatgggatattttctcccggtggcgccatatctaacatgtatgccatgatgatcgcacgctttaagatgttcccagaagtcaaggagaaaggaatggctgctcttcccaggctcattgccttcacgtctgaacatagtcatttttctctcaagaagggagctgcagccttagggattggaacagacagcgtgattctgattaaatgtgatgagagagggaaaatgattccatctgatcttgaaagaaggattcttgaagccaaacagaaagggtttgttcctttcctcgtgagtgccacagctggaaccaccgtgtacggagcatttgaccccctcttagctgtcgctgacatttgcaaaaagtataagatctggatgcatgtggatgcagcttggggtgggggattactgatgtcccgaaaacacaagtggaaactgagtggcgtggagagggccaactctgtgacgtggaatccacacaagatgatgggagtccctttgcagtgctctgctctcctggttagagaagagggattgatgcagaattgcaaccaaatgcatgcctcctacctctttcagcaagataaacattatgacctgtcctatgacactggagacaaggccttacagtgcggacgccacgttgatgtttttaaactatggctgatgtggagggcaaaggggactaccgggtttgaagcgcatgttgataaatgtttggagttggcagagtatttatacaacatcataaaaaaccgagaaggatatgagatggtgtttgatgggaagcctcagcacacaaatgtctgcttctggtacattcctccaagcttgcgtactctggaagacaatgaagagagaatgagtcgcctctcgaaggtggctccagtgattaaagccagaatgatggagtatggaaccacaatggtcagctaccaacccttgggagacaaggtcaatttcttccgcatggtcatctcaaacccagcggcaactcaccaagacattgacttcctgattgaagaaatagaacgccttggacaagatttataataaccttgctcaccaagctgttccacttctctagagaacatgccctcagctaagccccctactgagaaacttcctttgagaattgtgcgacttcacaaaatgcaaggtgaacaccactttgtctctgagaacagacgttaccaattatggagtgtcaccagctgccaaaatcgtaggtgttggctctgctggtcactggagtagttgctactcttcagaatatggacaaagaaggcacaggtgtaaatatagtagcaggatgaggaacctcaaactgggtatcattttgcacgtgctcttctgttctcaaatgctaaatgcaaacactgtgtatttattagttaggtgtgccaaactaccgttcccaaattggtgtttctgaatgacatcaacattcccccaacattactccattactaaagacagaaaaaaataaaaacataaaatatacaaacatgtggcaacctgttcttcctaccaaatataaacttgtgtatgatccaagtattttatctgtgttgtctctctaaacccaaataaatgtgtaaatgtggacaca

SEQ ID NO: 137395 - DNA, 680 bp, Homo sapiens
  Payload ID: 6899
  Gene Symbol: GAD2
  Gene Name: glutamate decarboxylase 2 (pancreatic islets and brain, 65kDa)
  ENST ID: ENST00000376248
  CDS Start-End: 190-579
tccaagagggctctgaggccgtggcgctcttcccccagcgcggcccttgggatggcgggtggccgacgatccaggcgctcgtgcgctcactgaatcgatgacggctggcttccctaggccgctggggcctcggacctgctgccggcgtgtgatggagaaaggcccactttggcgtttctgcaagatgttatgaacattttacttcagtatgtggtgaaaagtttcgatagatcaaccaaagtgattgatttccattatcctaatgagcttctccaagaatataattgggaattggcagaccaaccacaaaatttggaggaaattttgatgcattgccaaacaactctaaaatatgcaattaaaacagggcatcctagatacttcaatcaactttctactggtttggatatggttggattagcagcagactggctgacatcaacagcaaatactaacatgttcacctatgaaattgctccagtatttgtgcttttggaatatgtcacactaaagaaaatgagagaaatcattggctggccagggggctctggcgatgggatattttctcccggtacatgatatttcaactttctttgtgttttttcttctaatatgcaatgccttgttgtaaacctagggaagattaaaaatctagcctatgcctctgcttaggttaaata

SEQ ID NO: 137396 - DNA, 5858 bp, Homo sapiens
  Payload ID: 6899
  Gene Symbol: GAD2
  Gene Name: glutamate decarboxylase 2 (pancreatic islets and brain, 65kDa)
  Uniprot ID: Q05329
  ENST ID: ENST00000376261
  CDS Start-End: 504-2261
gcggccgcccgcacttcccgcctctggctcgcccgaggacgcgctggcacgcctcccaccccctcactctgactccagctggcgtgcatggtctgcctcgcatcctcacgactcagctccctccctctctcgtgtttttttcctccgccgccccctcattcatccccactgggctccctttccctcaaatgctctggggctctccgcgctttcctgagtccgggctccgaggacccttaggtagtcccggtctcttttaaagctccccggcttccaaagggttgccacgtccctaaaccctgtctccagctcgcatacacacacgcacagacacgcacgttttctgttcctgcgtgacacccgccctcgccgctcggccccgccggtccccgcgcggtgccctcctcccgccacacgggcacgcacgcgcgcgcagggccaagcccgaggcagctcgcccgcagctcgcactcgcaggcgacctgctccagtctccaaagccgatggcatctccgggctctggcttttggtctttcgggtcggaagatggctctggggattccgagaatcccggcacagcgcgagcctggtgccaagtggctcagaagttcacgggcggcatcggaaacaaactgtgcgccctgctctacggagacgccgagaagccggcggagagcggcgggagccaacccccgcgggccgccgcccggaaggccgcctgcgcctgcgaccagaagccctgcagctgctccaaagtggatgtcaactacgcgtttctccatgcaacagacctgctgccggcgtgtgatggagaaaggcccactttggcgtttctgcaagatgttatgaacattttacttcagtatgtggtgaaaagtttcgatagatcaaccaaagtgattgatttccattatcctaatgagcttctccaagaatataattgggaattggcagaccaaccacaaaatttggaggaaattttgatgcattgccaaacaactctaaaatatgcaattaaaacagggcatcctagatacttcaatcaactttctactggtttggatatggttggattagcagcagactggctgacatcaacagcaaatactaacatgttcacctatgaaattgctccagtatttgtgcttttggaatatgtcacactaaagaaaatgagagaaatcattggctggccagggggctctggcgatgggatattttctcccggtggcgccatatctaacatgtatgccatgatgatcgcacgctttaagatgttcccagaagtcaaggagaaaggaatggctgctcttcccaggctcattgccttcacgtctgaacatagtcatttttctctcaagaagggagctgcagccttagggattggaacagacagcgtgattctgattaaatgtgatgagagagggaaaatgattccatctgatcttgaaagaaggattcttgaagccaaacagaaagggtttgttcctttcctcgtgagtgccacagctggaaccaccgtgtacggagcatttgaccccctcttagctgtcgctgacatttgcaaaaagtataagatctggatgcatgtggatgcagcttggggtgggggattactgatgtcccgaaaacacaagtggaaactgagtggcgtggagagggccaactctgtgacgtggaatccacacaagatgatgggagtccctttgcagtgctctgctctcctggttagagaagagggattgatgcagaattgcaaccaaatgcatgcctcctacctctttcagcaagataaacattatgacctgtcctatgacactggagacaaggccttacagtgcggacgccacgttgatgtttttaaactatggctgatgtggagggcaaaggggactaccgggtttgaagcgcatgttgataaatgtttggagttggcagagtatttatacaacatcataaaaaaccgagaaggatatgagatggtgtttgatgggaagcctcagcacacaaatgtctgcttctggtacattcctccaagcttgcgtactctggaagacaatgaagagagaatgagtcgcctctcgaaggtggctccagtgattaaagccagaatgatggagtatggaaccacaatggtcagctaccaacccttgggagacaaggtcaatttcttccgcatggtcatctcaaacccagcggcaactcaccaagacattgacttcctgattgaagaaatagaacgccttggacaagatttataataaccttgctcaccaagctgttccacttctctaggtagacaattaagttgtcacaaactgtgtgaatgtatttgtagtttgttccaaagtaaatctatttctatattgtggtgtcaaagtagagtttaaaaattaaacaaaaaagacattgctccttttaaaagtcctttcttaagtttagaatacctctctaagaattcgtgacaaaaggctatgttctaatcaataaggaaaagcttaaaattgttataaatacttcccttacttttaatatagtgtgcaaagcaaactttattttcacttcagactagtaggactgaatagtgccaaattgcccctgaatcataaaaggttctttggggtgcagtaaaaaggacaaagtaaatataaaatatatgttgacaataaaaactcttgcctttttcatagtattagaaaaaaatttctaatttacctatagcaacatttcaaatgtatttaaatacatataattttacaaaaggaaaatatatatattaaaaaagatatcctattttgtaacatatagatttttattttatataggttatacaaactgcgggggcagatataaaatctaagccagatttttttttcctttctcttaatggaggcacaataaaacacttagcaaagttattttgaaacattgacccacgaaattcttaaaaggtattattgcttctttctatacatgttatggcttatcacatctctaaagttagtatttcaagacaaacacaaaagaatactgcgagttctttaaaataattgatcccattggcagtaagattctcttcccctttaagttttccacccattttactcttagcggactcactctgcaagcgtgacaaaccaggcttcatctcagattaaattagggtaattgtctctattctgctttccagttcggcctgttttgaacagaaggttgatgctagttcttgaggcatcttccaaatagtattcttttattaggtcatttgaattaattagagaaagtaaaaataaaaccttatcagcctgagcaaagaggaatgaagcacactcccagaatgtggtgagcccagaaaattaaagttggccttgggagaagagatctctgtgggacaataatgacatcatcctggcgccatattgccactgtccaggaaagagaaatttacctccaggccagttgcgcatttccatcccctccccattcctccccacaaagtctctcccactagactccctaccactgggacccaaaatagttactttatattccatgggtggttgtttttcttccatgaaatgagcctctcaccctagattttgaggcattatcttaagattttcctttatccatctcccatcgagatccaaagtgaccagaatatgcagaaataataagatccttagaattcaaaatagtatttttaaaacatccttctttccctgtgaacctgatagaaaaacatgagctaacaaaagcttccatagatatttatggggtcacacatcgtcagattccaagtgctgattggagaacaatagattgatatgcagactgcaaatgcaaatttaggaacattctccatttctgaatggaccaggtagttcagtactcagactgcaggtatacaagggaagagagaaggccctgcccttcaacgggtagaaatgccctacaatataacatagagaaatgccctataatataaccacaggatccagccatctgaaattttcataagcttccccctacattatttctcctaggctatatgcaaaaacagtgataacttgatatgaacatggctttgggccctttctgtctagaaaaacaaatgggttcactatgacaatcagaaataaactctttcatctgtcccgcagaatttcatgaaggagtaaccttccattctaggctttgtctaatggccaagcattagacaaagcattagaaagcagttcctttctcaaaactgcctgctgagaataagcacatagctgcccgactatccggagcctcaggcccaaaggttccacttcagagacagagatgctaattgatccaacctgctgtccttcgtggagaagacagtggggcccagtgccctggtgaaccaaccctgctgtactccaggatgctttatcttttgagttacagatcctagattataaactgctgctttttaggttaatgagatggtaaaattttaaaggacaatttgtgcctatatatgaaattccagcaaaacaattctagcaacaacaatagctcttcttccccgctcccctaccccttcccagtactccttcaaattggctgagagccttgctcaggcctgtgcagggaaatccttaccaactgtagcccaaagaaggaagcaaataaaagcctagtaggtcccagtagtttaataaatcatcttgaaaggagatgtggaatcaggtcagaagagagtaagggaggaagggagggagggagggagggagggaaggagggagggaggaaggaaatgaagggagggagggagggaggaaagaagggagattatttttaatattagcccaaattcccagtgccatggtctttatgtgtgcccattctttacaaatcttagaaaagtttggttttagctttaatcagaactgacatggccattttcatttatacagcaatattgtgtttatcatttaaaatacttgaacaaacaagtgtgatatgtctttatctgagacctatacatggtatggacttcatatactgccacaggatgtgaggaaagaaaaggaaatcaattctgactgtgttgcctttattatctggataatactgtcttgtcacctcagattggggttgtgcactttagatctgaactgtacagtgttgcaaatcaacatgtgtttctgtaaaagcttgtacaatatattattgatatgtctttttctgtgtggtagctgtattgaactttgatattatgaaaactacatttgcatctgttcctgttctctctctctctctctttcctaactatatgccctccacatcggctctaatagagaacatgccctcagctaagccccctactgagaaacttcctttgagaattgtgcgacttcacaaaatgcaaggtgaacaccactttgtctctgagaacagacgttaccaattatggagtgtcaccagctgccaaaatcgtaggtgttggctctgctggtcactggagtagttgctactcttcagaatatggacaaagaaggcacaggtgtaaatatagtagcaggatgaggaacctcaaactgggtatcattttgcacgtgctcttctgttctcaaatgctaaatgcaaacactgtgtatttattagttaggtgtgccaaactaccgttcccaaattggtgtttctgaatgacatcaacattcccccaacattactccattactaaagacagaaaaaaataaaaacataaaatatacaaacatgtggcaacctgttcttcctaccaaatataaacttgtgtatgatccaagtattttatctgtgttgtctctctaaacccaaataaatgtgtaaatgtggacaca

SEQ ID NO: 137397 - DNA, 641 bp, Homo sapiens
  Payload ID: 6899
  Gene Symbol: GAD2
  Gene Name: glutamate decarboxylase 2 (pancreatic islets and brain, 65kDa)
  ENST ID: ENST00000428517
  CDS Start-End: 78-641
gcgcgcgcagggccaagcccgaggcagctcgcccgcagctcgcactcgcaggcgacctgctccagtctccaaagccgatggcatctccgggctctggcttttggtctttcgggtcggaagatggctctggggattccgagaatcccggcacagcgcgagcctggtgccaagtggctcagaagttcacgggcggcatcggaaacaaactgtgcgccctgctctacggagacgccgagaagccggcggagagcggcgggagccaacccccgcgggccgccgcccggaaggccgcctgcgcctgcgaccagaagccctgcagctgctccaaagtggatgtcaactacgcgtttctccatgcaacagacctgctgccggcgtgtgatggagaaaggcccactttggcgtttctgcaagatgttatgaacattttacttcagtatgtggtgaaaagtttcgatagatcaaccaaagtgattgatttccattatcctaatgagcttctccaagaatataattgggaattggcagaccaaccacaaaatttggaggaaattttgatgcattgccaaacaactctaaaatatgcaattaaaacaggtattgtctcatcgaaaataataaagctcttttttcgtttacaa

SEQ ID NO: 137398 - DNA, 3759 bp, Homo sapiens
  Payload ID: 6900
  Gene Symbol: GADL1
  Gene Name: glutamate decarboxylase-like 1
  Uniprot ID: Q6ZQY3
  ENST ID: ENST00000282538
  CDS Start-End: 152-1717
gcgcgtcctcgtccctccgtttgcactggtgttctctccgcggctgcctggtgcacctgcgggtcccccggggggcgctgcctcggcaaccaccgtcgccgcccagactgcgggagccgcgcccggggcagcctggagtgggggagcggagatgagcagcgactcggaccgccagtgtcctgtggacggagatattgatcaacaagagatgattccaagtaagaagaatgctgttcttgtggatggggttgtgctgaatggtcctacaacagatgcaaaagctggagaaaaatttgttgaagaggcctgtaggctaataatggaagaggtggttttgaaagctacagatgtcaatgagaaggtgtgtgaatggaggcctcctgaacaactgaaacagcttcttgatttggagatgagagactcaggcgagccaccccataaactattggaactctgtcgggatgtcatacactacagtgtcaaaactaaccacccaagatttttcaaccaattgtatgctggacttgattattactccttggtggcccgatttatgaccgaagcattgaatccaagtgtttatacgtatgaggtgtccccagtgtttctgttagtggaagaagcggttctgaagaaaatgattgaatttattggctggaaagaaggggatggaatatttaacccaggtggctcagtgtccaatatgtatgcaatgaatttagctagatacaaatattgtcctgatattaaggaaaaggggctgtctggttcgccaagattaatccttttcacatctgcagagtgtcattactctatgaagaaggcagcctcttttcttgggattggcactgagaatgtttgctttgtggaaacagatggaagaggtaaaatgatacctgaggaactggagaagcaagtctggcaagccagaaaagagggggcagcaccgtttcttgtctgtgccacttctggtacaactgtgttgggagcttttgaccctctggatgaaatagcagacatctgcgagaggcacagcctctggcttcatgtagatgcttcttggggtggctcagctttgatgtcgaggaagcaccgcaagcttctgcatggcatccacagggctgactctgtggcctggaacccacacaagatgctgatggctgggatccagtgctgtgctctccttgtgaaagacaaatctgatcttcttaaaaaatgctactctgccaaggcatcttacctcttccagcaggataaattctatgatgtgagctatgacacaggagacaagtctatccagtgtagcagaagaccagatgcattcaagttctggatgacctggaaggccctgggtacattaggccttgaagaaagagttaatcgtgctcttgctttatctaggtacctagtagatgaaatcaagaaaagagaaggattcaagttactgatggaacctgaatatgccaatatttgcttttggtacattccaccgagcctcagagagatggaagaaggacccgagttctgggcaaaacttaatttggtggccccagccattaaggagaggatgatgaagaagggaagcttgatgctgggctaccagccgcaccggggaaaggtcaacttcttccgccaggtggtgatcagccctcaagtgagccgggaggacatggacttcctcctggatgagatagacttactgggtaaagacatgtagctgtggctttggtcccccagaggcatagatcctatcctgggagagtttagatccagaacatcttggagatacacagtagattgcagcccttctgatgagaaatagggaatactcccagtccaggcccagcaaaaccaaaatgctaagcaatgaatattaaggactctctagctgcctgggcattactgttgctaaaagaagaaagtttaaaaaaaaaaatgattttctcaaggaatgcccctggaacacagctctgaagagagtttagtaagtaccatgtaggttctggattctaagcttacattgctctttaaagaacttataaactaacggtttaaagcagtggttctcaaagtgtggtccctggactatcagcatcaaagcatcacctgggaacttgctaaaaatgcagattctcaggctttctctagaccaactggatcagaagctctgggggtgaggcccagtattctgtgttttaacaagcccgtcagggaattctgatgcacagtaaaatccgagaaacactggtttaagaaaaaccttgtaatgatcgaatacccactctgatgttttgccagcaaagggatatctaatatttcagaagcctctgagccagtctttgaaaaaatacaactatggcatctgcagcacaaatatttaaggacatcagaagcatgtcaaagctatttttaaagagagaaactgtataagatgtttacttcatagagatttatgttttatgcaggctgaatgtttatctcaaaagttaaaattatccattctcaaaagttaaaattatatatatatatatatatacacacacacacatatatatatatatataattcaaagcacaataattgaaagcacaataattgacagaaaaatacaggttctattaataaattaataaactgttggtcttcaaaatagaaatgcatgtaatatccatattagttttttcttggtagacaactggaaggttttcttttttttcgtctatgactaattttctttattcaagatacctgaactggggtgctttttaagaaaaatttgggaaatatatatgtttctgtgatatacatatatacatatatatgtatatatatacacacacatacatatgtgtgtgtatagtatatatatatatacacacatatatgtttctgtgttcctcttttagcttgaggggcttgtttattatcttgctctgtgcctcatagggaataaacacaatgaagtccagggttgtacaacattccctttcctaagctttgaaatgtcagtatagattattaagtggtttatattacagaatctgggattcagcagactttcagtgtaaatgcttcctccatttctcctgagagtgggtgattttaattctatctctgaccctggtcctaggtttctaggagagttttgtttaactaagaaattgacagaattcataggtgtgggtgtagagttcaccaagataagattatgaatataattaaaggtctgcattaaaaggtgaatgattgaagagtgttaaagcattagacttagcacattcaataaccttttcgtactccattgttaaccaatgtcatttaaattttgagtactatttgcttttattgcttattttcattttagtgtgcacagtttctcggtatctctattggtcaaagaatattaaatctgtctctgaattacttcaaattctcaggtgaaacctattggtgtgtgtgtgtgtgtgtgtgtgtttattttgcatttcttgttgcctttttgttttaatgtctacataaaatatttctaaaattgatgtttgtaacaatttgggtttcatgaaacaaaaaggaacattactatacttagtgttgttgacttttcttttcctgtcatctcctctttactggattgtaccaatacattttagaagtgaactggacttggttggcattttagtttaatgactgaaaaagtaggttgaaagctctctgtattttagttaacaccttgaataaaatggaaaaagcagttatagc

SEQ ID NO: 137399 - DNA, 4509 bp, Homo sapiens
  Payload ID: 6900
  Gene Symbol: GADL1
  Gene Name: glutamate decarboxylase-like 1
  Uniprot ID: Q6ZQY3
  ENST ID: ENST00000454381
  CDS Start-End: 48-1304
agactgcgggagccgcgcccggggcagcctggagtgggggagcggagatgagcagcgactcggaccgccagtgtcctgtggacggagatattgatcaacaagagatgattccaagtaagaagaatgctgttcttgtggatggggttgtgctgaatggtcctacaacagatgcaaaagctggagaaaaatttgttgaagaggcctgtaggctaataatggaagaggtggttttgaaagctacagatgtcaatgagaaggtgtgtgaatggaggcctcctgaacaactgaaacagcttcttgatttggagatgagagactcaggcgagccaccccataaactattggaactctgtcgggatgtcatacactacagtgtcaaaactaaccacccaagatttttcaaccaattgtatgctggacttgattattactccttggtggcccgatttatgaccgaagcattgaatccaagtgtttatacgtatgaggtgtccccagtgtttctgttagtggaagaagcggttctgaagaaaatgattgaatttattggctggaaagaaggggatggaatatttaacccaggtggctcagtgtccaatatgtatgcaatgaatttagctagatacaaatattgtcctgatattaaggaaaaggggctgtctggttcgccaagattaatccttttcacatctgcagagtgtcattactctatgaagaaggcagcctcttttcttgggattggcactgagaatgtttgctttgtggaaacagatggaagaggtaaaatgatacctgaggaactggagaagcaagtctggcaagccagaaaagagggggcagcaccgtttcttgtctgtgccacttctggtacaactgtgttgggagcttttgaccctctggatgaaatagcagacatctgcgagaggcacagcctctggcttcatgtagatgcttcttggggtggctcagctttgatgtcgaggaagcaccgcaagcttctgcatggcatccacagggctgactctgtggcctggaacccacacaagatgctgatggctgggatccagtgctgtgctctccttgtgaaagacaaatctgatcttcttaaaaaatgctactctgccaaggcatcttacctcttccagcaggataaattctatgatgtgagctatgacacaggagacaagtctatccagtgtagcagaagaccagatgcattcaagttctggatgacctggaaggccctgggtacattaggccttgaagaaagagttaatcgtgctcttgctttatctaggtactagcctctctctctctctctctctctctctttctgtgtgtgtgtgtgtgtgtgtgtgtgtgtgtgtgtgtgtgtgtgtctatctgtgtctgtaataggaagacctaaggaaagtaatacttgaaatgtgttgcaagtacatgttttcatttgtgcattatttcatccaatacacattttctcagtacctactaagtgttaggaattatgaacagagcagtcctatcacctccctccaagatcctagcctactgagatgcacaaatgaccctcatttttggcaaggtgaggtatagagtccaagatcaatcaggagggcttctctagtgtgttcttgaggcacactggcagaggctccttggaggaagtgactttcaactgagatctaatgaagagaaggtggtattgtttgactctgtgtccccacccagatctcatcttgaattgtattcccgtaattcccaggtgttgtgggagggacctggtgggaaataatttgaattatgggggctattttccccatactgcactgatagtgaataagtctcacaagatctgatggttttatcaggggtttctacttttgcattcttcctcgttttctcttgctgctgccatgcaagaagtgcctttcggcttccgccatgaattgaggcctccccagccatgtggaactgtaagtccaattaaacctttttcttcccagtcttgggtatgtatttatcagcagcatgaaaacagactaatatggtaaattagtaccagtagaatggggtgctgctgaaaagatacccaaaaatgtggaagcgactttggaactgggtaacaggcagaggttgaaatagtttgaagggctcagaagaagacaggaaaattcagaacttcctagagacttgttgaatggctttgacaaaaatgctgatagtgatacgaacaataaggtccaggctgaggtagtctcagatggagatgaggaacttgttgggaactggagcaaagttgactcttgttacgttttagcaaacagactggcggcattttgcccctgtcctagagatttgtggaactttgaacttgagagagatgatttatggtatctgatggaagaaatttttaagcagcaaagcattcaagaggtgacttggatgccattaaaagcattcccttttaaaagggaaacagcatcaaagttcagaaaattttcagcctgacgatgcagtagaaaaaacccattttttgaggagaaattcaagctagctgcagaaatttgcctaagtaacaaggagctgaatgataatcctcaagacaatagggaaaatgtctccagggcatgtcataggtcttcatggcagtccctcccatcagacccagaagcctaggaggaataaatgatttcatgggcctggggacacacagggtccccaagctgtgtgcagcctacagacttggtgccctgcatcccagctgctccagccattgctaaaaggggccaaggtgcagctcagcccatggtttcagagggtgcaagccccaaaccttagcagcttccatgtggtgttgagcatgtgggcacacaagtcaagaattgaggtttgggaacctccacctaaatttcagaagaggtatggaaacccctggatgcccagataaaagtttgctgcaggggagggggccctcatggagaccctctgctagggcagtgtggaagggaaatgtggggtcagagcccccacacagagtccctactggggcactgcctagtggagctatgagacaaaggccaccatcttccagaccccagaatggtaggtccactgacagcttacactgtgtgccagcatgtgaaagcagccatgatgggggctataccctgcaaagccacaggggtggagctgccaaaggctatgggaacccacctcttgcatcagcgtgacccagatatgagacatggagtcaaaggagatcattttggaactttagaatttgactgccctgctggaattcagacttgcatgggtcctgtaacccctttgttttgaccaatttctcccatttggaatggctgtatttacccaatatctgtatccccattgtatctaggaagttactagcctgcttttgaccttacaggttcgtaggcagaagagacttgccttgtctcagatgaaaccttggactgtggacttttgggttaatgctagaatgagttaagactttaggggactgttgggaaggtgtgattggttttgaaatgtgagcacgtgagatttggaggggcaaggggcagaatgacatagtttggctctgtgtcctcacccaaatctcatcttgaattctactcccataattcccagatgttgtgggcgggacgcagtgggagataatatgaatcatgggggtggtttcccccatactgctgtcatggtagtgcataagtctcacaagctctgatggttttatcaggggtttctgcttttgcgtttctttttctcttgccacttccacgtaagaagtgccttttgcctcccaccatgattctgaggcctcctccagcctcagggaactgtggaactataagttcaattaaacctttttcttcccagtctcgggtatgtctttatcagcagcgtgaaaacagactaaaacagaaggggagaagaatgacccaagtggaaggagcagcaggcccaagtctctggatgtgaggtgacacaaaagtctggatgtgacattaaggacctgaaaagcaaatgatctgtgagttgtggcggcagcttaagtctcgaagggaaaggcagtgtggaagcaccatgtttacttgccttgtagtaaacattagaaataaaattgttgtcacactttcaagaacattagaaaagctcaagatataggtgccagacattgctacttgaataggactgaactgctaaacttagatcagtggtggacaggccatagccaaatttagttttaaatgtgttttgttgagcttatactgttcaaggttaactttcatggtgttaaacattcaaacatttcaatatttgaaatgcttttaaaaaaataaatttataaaaaacctggattttttgcttttctcaaagcttagaatgctctcaatcccacatggtaacaactagctgaacatgatgatgcctgactctggaaaaacacagtccctatcatttcttacagtttaaaaaacaaaa

SEQ ID NO: 137400 - DNA, 3039 bp, Homo sapiens
  Payload ID: 6901
  Gene Symbol: GLUD1
  Gene Name: glutamate dehydrogenase 1
  Uniprot ID: P00367
  ENST ID: ENST00000277865
  CDS Start-End: 98-1774
gggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaa

SEQ ID NO: 137401 - DNA, 2493 bp, Homo sapiens
  Payload ID: 6902
  Gene Symbol: GLUD2
  Gene Name: glutamate dehydrogenase 2
  Uniprot ID: P49448
  ENST ID: ENST00000328078
  CDS Start-End: 98-1774
gggcaacccgcgccggacccttccttcctagtcgcggggagtctgagaaagcgcacctgttccgcgaccgtcacgcacccctcctccgcctgccgcgatgtaccgctacctggccaaagcgctgctgccgtcccgggccgggcccgctgccctgggctccgcggccaaccactcggccgcgttgctgggccggggccgcggacagcccgccgccgcctcgcagccggggctcgcattggccgcccggcgccactacagcgagttggtggccgaccgcgaggacgaccccaacttcttcaagatggtggagggcttcttcgatcgcggcgccagcatcgtggaggacaagttggtgaaggacctgaggacccaggaaagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactataccgaaaatgaattggaaaagatcacaaggaggttcaccatggagctagcaaagaagggctttattggtcctggcgttgatgtgcctgctccagacatgaacacaggtgagcgggagatgtcctggattgctgatacctatgccagcaccatagggcactatgatattaatgcacacgcctgtgttactggtaaacccatcagccaagggggaatccatggacgcatctctgctactggccgtggtgtcttccatgggattgaaaacttcatcaatgaagcttcttacatgagcattttaggaatgacaccagggtttagagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggtcgactgtgacatactgatcccagctgccactgagaagcagttgaccaaatccaacgcacccagagtcaaagccaagatcattgctgaaggtgccaatgggccaacaactccagaagctgataagatcttcctggagagaaacattttggttattccagatctctacttgaatgctggaggagtgacagtatcttactttgagtggctgaagaatctaaatcatgtcagctatggccgtttgaccttcaaatatgaaagggattctaactaccacttgctcctgtctgttcaagagagtttagaaagaaaatttggaaagcatggtggaactattcccattgtacccacggcagagttccaagacagtatatcgggtgcatctgagaaagacattgtgcactctgccttggcatacacaatggagcgttctgccaggcaaattatgcacacagccatgaagtataacctgggattggacctgagaacagctgcctatgtcaatgccattgaaaaagtcttcaaagtgtacagtgaagctggtgtgaccttcacatagatggatcatggctgacttcctcactaacctcttcacgtgtaacttctgcagacctaccacaagtttacatgtaaccacagaaatccctttctctcctgactcattactaatggataccattctcaacaagtcaatccaaatcagcccgttaaggagaaagaaattaatatacaagctgagtgtgaaagtagaaatcacctacaccagagagctattttggtattttgcctttaaataaaaagcctcctccatatggctgtgcagccttgctctgtggcttttcccagcacaatcagtgctagtgctggggaagggacagtcaagagcagtcagttgcttacttattttgctctggatgagtctgggacacgctgtaactttaacacatttaagaagaaggtgtgtggccttttcagaaggtggcatggtcctcaagtgagttcttagtattttatatcagcaaaataactcaattttgcagattgcaaacaaatataaaagctgtttctgtttatgaattttattcttttagaatagaataagtacatgctgctgtaataaaattgcctttaatcacttaacaagcctaaccttgactcagtgaatgcctataaaaataataaatgaaaaaaaacagtatttttatatcataaaagtttcatttgtagcttatcattcacgtattgttgtccagcaaacattaaaagccctgtggataa

SEQ ID NO: 137402 - DNA, 5216 bp, Homo sapiens
  Payload ID: 6903
  Gene Symbol: GRIP1
  Gene Name: glutamate receptor interacting protein 1
  Uniprot ID: Q9Y3R0
  ENST ID: ENST00000359742
  CDS Start-End: 242-3628
gtgattgtgaagggggaggaggctgtggcaggcaggggtggtagtagtagtgaatgacacagatttgccagatgacatgtagcggacctctgcatcagccaagaggaattaagctttgtcactccccactgggactacctttctcctggtatgtgcgcaaggaattcatatgctgctgctgctgcagccaccagagcagagagccttgagtacactttgccacagaaagcagtgagcaagaatgatagctgtctcttttaaatgccgttgtcaaattctgaggcgacttactaaagatgagagtccctacactaaatccgccagccagacaaagccgcctgatggagcgttggctgtgaggagacagagcatcccagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatggactctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatgtgaaaattcagaggagcgacaggcaacttacctgggattcctgggccagcaaccacagcagccttcacaccaaccatcactataacacgtaccaccctgaccattgcagagtaccagccctgacattcccgaaagcacctcctccaaacagccctccagctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcattgtccttagcctccagcacagtaggattggctgggcaggttgttcacacagaaaccacagaggttgtgctgacggcagatcctgtcacaggatttgggatccaactgcagggcagtgtgtttgccacagaaactctctcttctccacctctgatttcctatatcgaagctgacagcccagcagagagatgtggggtgctacagattggagacagagtgatggccatcaatggaattccaacagaagacagcaccttcgaagaagccagtcagctcctccgagactcttcaatcacgagcaaggtcacactggaaatcgagtttgatgttgcagagtctgtcatcccaagtagtggaacatttcatgtaaagctgcctaagaagcacaatgtggaacttggaataaccataagttcaccatccagtagaaaaccaggagaccccctcgtcatttcagatatcaagaaagggagtgtggcacacagaactgggaccctggaacttggggataaattgctcgcaatagataatatccggctggacaactgttccatggaagatgcagttcagatcctccagcaatgtgaagacctggtgaagctcaaaatccgcaaagatgaagataattcagatgagcaagaaagttccggagcaattatttacaccgtggagcttaaacgctacggggggccccttggcatcacaatttcaggaactgaagagccgtttgatcctataatcatttcaagcctcactaaagggggattagctgaaagaactggcgcaatccacataggagaccgaatcctagccatcaatagcagcagcttgaaagggaagcctctgagtgaagccatccatttgttacagatggcaggagagactgtcaccttgaaaattaagaaacagacagatgcccagtcagcatcgagccccaagaagttccctatttctagccatttgagtgacctgggggatgtggaggaggactcctcaccagcacagaagccaggcaagctctccgacatgtacccctccacggtgcccagtgtggacagtgctgtggattcatgggatgggtctgcaatagacaccagctatggaactcaaggcactagttttcaggcctcaggatacaatttcaacacctatgactggaggagtccaaaacagagaggcagcttgtccccagtcactaagcctcgaagccagacttacccagatgtggggctgagttatgaagactgggaccggtccacagccagtggttttgcaggggctgccgatagtgcagagacagaacaagaggagaacttctggtctcaagcgctggaggatttggaaacctgcggacagtcaggaattctgagagaactggaggagaaagctgacaggcgtgtgtctttgagaaacatgactctcttggcaacaatcatgtcggggagcacgatgagtttgaatcatgaggctccaacacctcgcagtcagctggggcgacaggccagcttccaggagcgcagcagctcgcggccgcactacagccaaacaactcggagcaacaccctgccttcagatgtgggtaggaagtcagtaaccctgagaaaaatgaaacaagaaataaaggagatcatgtctccaactcctgtggagctgcacaaggtgaccttgtacaaggactctgacatggaggactttgggttcagtgtagcagatggcttactggagaaaggagtgtatgtcaaaaatattcgcccagctgggccaggagatcttggtggcttaaagccctatgacaggctcttacaggtgaatcatgtccgaaccagagactttgactgctgccttgttgtgcccctcatagcagaatccgggaataagctggacctggttattagtagaaacccactggcttcacagaagtctatagaccaacagagtctaccaggagattggagtgaacagaacagtgcttttttccagcagcctagccacggtggtaatttggagacacgagaacccactaatacattatagcaacgctttttataaagcaggacaaaagacaatatctacatggtgctaaaaatcctttaagatttctgtgacctttgaagcacagataatcaatcaacgtggcattaactgcaagcacaggggtcttttaaatctctctcatggctcatgttcacttcccttttcaagttgaagaggtttcttttttggtgaccactatggtatatggtgggcaatgccctgccagtcccaacggtagagaaaaataggccgtcccccacaactctacaattaacatcagaggaaattttttacaagttcatcttactatcactttttaaaaagagaaacatctgtttgaaaatattctctgtgatgatttccttaattcactttgaaatcagtttcttactatgaagtcattaatgtaagaacttggccaacaaagcttttcttctcataggctggctctactaggggaactagtgtttggtaaactgctgggactaccacaatgggaggggtacaggtataaaattaagttatcttaaaatgtttcagcaatgatgcacgtaggagaccataataggtggtggtaaatgttttgcccacgtataggaatgattttaactaagatgtatgctattccctatgcaacaaattatcaaacaggatatgtcttgtgacctgttttttttttaaggacacatttttaatagctgaaaatctctgataatgaattagagtgtgtagtaaacatgagaattagttatattatcttatttttaaaattcaagactaagaacttcagagaatgaagagtctattaaaatgaggttcatcttaatgataggcaaaccaaactcatactgcttgacatgttttgaaaactggtaatattgagggtgtacagcacatgtacttaaaaatgacactggactatcttttgctctgagccatgccacttaccgaaattgtaaatacatttttcacaaatgcattgccaattattaccatccctcaaagcaataaattgtgacagttgctttaaatgtttgtcagcaactgttttcatttgttcagatattttgaatagctacactaataactgttattatttggtgaacataaaaaaataaatagatctgtatattgatggtagactctccatattgaaatgattattttccaaacattttcattttggtcaataattcaaactaccacttaggcaaagtattcgaacactgtgtcctttgtttaaggaaatataaaaaaaaaatcacctttctttttgtgcaaaaaaaatattatttcaatcacatttcagaaccgccagggcaagaaagtataaagcaggatcatgttaagaaaaaagaaaaaaagatcatgagtcacttaaatatgtatttttatttgtaacaaacaagtattaaactgtaaagtatttttgtacaaatttaatactttaatagcatggtatttatcgtctatgtatggttttggggaattcaaaattgttcaaatatttgtatggaaaaaaataaaaccctctaccaaatggaataaacagtgattttaaaaagccaaataaagaggatatgcatta

SEQ ID NO: 137403 - DNA, 4888 bp, Homo sapiens
  Payload ID: 6903
  Gene Symbol: GRIP1
  Gene Name: glutamate receptor interacting protein 1
  Uniprot ID: Q9Y3R0
  ENST ID: ENST00000398016
  CDS Start-End: 70-3300
ctgctgctgctgcagccaccagagcagagagccttgagtacactttgccacagaaagcagtgagcaagaatgatagctgtctcttttaaatgccgttgtcaaattctgaggcgacttactaaagatgagagtccctacactaaatccgccagccagacaaagccgcctgatggagcgttggctgtgaggagacagagcatcccagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatggactctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatgcagctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcattgtccttagcctccagcacagtaggattggctgggcaggttgttcacacagaaaccacagaggttgtgctgacggcagatcctgtcacaggatttgggatccaactgcagggcagtgtgtttgccacagaaactctctcttctccacctctgatttcctatatcgaagctgacagcccagcagagagatgtggggtgctacagattggagacagagtgatggccatcaatggaattccaacagaagacagcaccttcgaagaagccagtcagctcctccgagactcttcaatcacgagcaaggtcacactggaaatcgagtttgatgttgcagagtctgtcatcccaagtagtggaacatttcatgtaaagctgcctaagaagcacaatgtggaacttggaataaccataagttcaccatccagtagaaaaccaggagaccccctcgtcatttcagatatcaagaaagggagtgtggcacacagaactgggaccctggaacttggggataaattgctcgcaatagataatatccggctggacaactgttccatggaagatgcagttcagatcctccagcaatgtgaagacctggtgaagctcaaaatccgcaaagatgaagataattcagatgagcaagaaagttccggagcaattatttacaccgtggagcttaaacgctacggggggccccttggcatcacaatttcaggaactgaagagccgtttgatcctataatcatttcaagcctcactaaagggggattagctgaaagaactggcgcaatccacataggagaccgaatcctagccatcaatagcagcagcttgaaagggaagcctctgagtgaagccatccatttgttacagatggcaggagagactgtcaccttgaaaattaagaaacagacagatgcccagtcagcatcgagccccaagaagttccctatttctagccatttgagtgacctgggggatgtggaggaggactcctcaccagcacagaagccaggcaagctctccgacatgtacccctccacggtgcccagtgtggacagtgctgtggattcatgggatgggtctgcaatagacaccagctatggaactcaaggcactagttttcaggcctcaggatacaatttcaacacctatgactggaggagtccaaaacagagaggcagcttgtccccagtcactaagcctcgaagccagacttacccagatgtggggctgagttatgaagactgggaccggtccacagccagtggttttgcaggggctgccgatagtgcagagacagaacaagaggagaacttctggtctcaagcgctggaggatttggaaacctgcggacagtcaggaattctgagagaactggaggagaaagctgacaggcgtgtgtctttgagaaacatgactctcttggcaacaatcatgtcggggagcacgatgagtttgaatcatgaggctccaacacctcgcagtcagctggggcgacaggccagcttccaggagcgcagcagctcgcggccgcactacagccaaacaactcggagcaacaccctgccttcagatgtgggtaggaagtcagtaaccctgagaaaaatgaaacaagaaataaaggagatcatgtctccaactcctgtggagctgcacaaggtgaccttgtacaaggactctgacatggaggactttgggttcagtgtagcagatggcttactggagaaaggagtgtatgtcaaaaatattcgcccagctgggccaggagatcttggtggcttaaagccctatgacaggctcttacaggtgaatcatgtccgaaccagagactttgactgctgccttgttgtgcccctcatagcagaatccgggaataagctggacctggttattagtagaaacccactggcttcacagaagtctatagaccaacagagtctaccaggagattggagtgaacagaacagtgcttttttccagcagcctagccacggtggtaatttggagacacgagaacccactaatacattatagcaacgctttttataaagcaggacaaaagacaatatctacatggtgctaaaaatcctttaagatttctgtgacctttgaagcacagataatcaatcaacgtggcattaactgcaagcacaggggtcttttaaatctctctcatggctcatgttcacttcccttttcaagttgaagaggtttcttttttggtgaccactatggtatatggtgggcaatgccctgccagtcccaacggtagagaaaaataggccgtcccccacaactctacaattaacatcagaggaaattttttacaagttcatcttactatcactttttaaaaagagaaacatctgtttgaaaatattctctgtgatgatttccttaattcactttgaaatcagtttcttactatgaagtcattaatgtaagaacttggccaacaaagcttttcttctcataggctggctctactaggggaactagtgtttggtaaactgctgggactaccacaatgggaggggtacaggtataaaattaagttatcttaaaatgtttcagcaatgatgcacgtaggagaccataataggtggtggtaaatgttttgcccacgtataggaatgattttaactaagatgtatgctattccctatgcaacaaattatcaaacaggatatgtcttgtgacctgttttttttttaaggacacatttttaatagctgaaaatctctgataatgaattagagtgtgtagtaaacatgagaattagttatattatcttatttttaaaattcaagactaagaacttcagagaatgaagagtctattaaaatgaggttcatcttaatgataggcaaaccaaactcatactgcttgacatgttttgaaaactggtaatattgagggtgtacagcacatgtacttaaaaatgacactggactatcttttgctctgagccatgccacttaccgaaattgtaaatacatttttcacaaatgcattgccaattattaccatccctcaaagcaataaattgtgacagttgctttaaatgtttgtcagcaactgttttcatttgttcagatattttgaatagctacactaataactgttattatttggtgaacataaaaaaataaatagatctgtatattgatggtagactctccatattgaaatgattattttccaaacattttcattttggtcaataattcaaactaccacttaggcaaagtattcgaacactgtgtcctttgtttaaggaaatataaaaaaaaaatcacctttctttttgtgcaaaaaaaatattatttcaatcacatttcagaaccgccagggcaagaaagtataaagcaggatcatgttaagaaaaaagaaaaaaagatcatgagtcacttaaatatgtatttttatttgtaacaaacaagtattaaactgtaaagtatttttgtacaaatttaatactttaatagcatggtatttatcgtctatgtatggttttggggaattcaaaattgttcaaatatttgtatggaaaaaaataaaaccctctaccaaatggaataaacagtgattttaaaaagccaaataaagaggatatgcatta

SEQ ID NO: 137404 - DNA, 592 bp, Homo sapiens
  Payload ID: 6903
  Gene Symbol: GRIP1
  Gene Name: glutamate receptor interacting protein 1
  ENST ID: ENST00000542309
  CDS Start-End: 145-592
atgtccacctaaatttcaaagggctgaaaaaatgagagtccctacactaaatccgccagccagacaaagccgcctgatggagcgttggctgtgaggagacagagcatcccagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtg

SEQ ID NO: 137405 - DNA, 567 bp, Homo sapiens
  Payload ID: 6903
  Gene Symbol: GRIP1
  Gene Name: glutamate receptor interacting protein 1
  ENST ID: ENST00000541947
  CDS Start-End: 2-567
gatggaccgcttcctgggttttgtcaaggcgataagaagatctaggagaagaaaggggaaaaagtaccgaccagaagaggattaccacgagggctatgaggatgtctattattacgcttcagagcattttcgaaatgagagtccctacactaaatccgccagccagacaaagccgcctgatggagcgttggctgtgaggagacagagcatcccagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttgg

SEQ ID NO: 137406 - DNA, 2980 bp, Homo sapiens
  Payload ID: 6903
  Gene Symbol: GRIP1
  Gene Name: glutamate receptor interacting protein 1
  ENST ID: ENST00000538164
  CDS Start-End: 1-2786
gtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatggactctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatgtgaaaattcagaggagcgacaggcaacttacctgggattcctgggccagcaaccacagcagccttcacaccaaccatcactataacacgtaccaccctgaccattgcagagtaccagccctgacattcccgaaagcacctcctccaaacagccctccagctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcattgtccttagcctccagcacagtaggattggctgggcaggttgttcacacagaaaccacagaggttgtgctgacggcagatcctgtcacaggatttgggatccaactgcagggcagtgtgtttgccacagaaactctctcttctccacctctgatttcctatatcgaagctgacagcccagcagagagatgtggggtgctacagattggagacagagtgatggccatcaatggaattccaacagaagacagcaccttcgaagaagccagtcagctcctccgagactcttcaatcacgagcaaggtcacactggaaatcgagtttgatgttgcagagtctgtcatcccaagtagtggaacatttcatgtaaagctgcctaagaagcacaatgtggaacttggaataaccataagttcaccatccagtagaaaaccaggagaccccctcgtcatttcagatatcaagaaagggagtgtggcacacagaactgggaccctggaacttggggataaattgctcgcaatagataatatccggctggacaactgttccatggaagatgcagttcagatcctccagcaatgtgaagacctggtgaagctcaaaatccgcaaagatgaagataattcagatgagcaagaaagttccggagcaattatttacaccgtggagcttaaacgctacggggggccccttggcatcacaatttcaggaactgaagagccgtttgatcctataatcatttcaagcctcactaaagggggattagctgaaagaactggcgcaatccacataggagaccgaatcctagccatcaatagcagcagcttgaaagggaagcctctgagtgaagccatccatttgttacagatggcaggagagactgtcaccttgaaaattaagaaacagacagatgcccagtcagcatcgagccccaagaagttccctatttctagccatttgagtgacctgggggatgtggaggaggactcctcaccagcacagaagccaggcaagctctccgacatgtacccctccacggtgcccagtgtggacagtgctgtggattcatgggatgggtctgcaatagacaccagctatggaactcaaggcactagttttcaggcctcaggatacaatttcaacacctatgactggaggagtccaaaacagagaggcagcttgtccccagtcactaagcctcgaagccagacttacccagatgtggggctgagttatgaagactgggaccggtccacagccagtggttttgcaggggctgccgatagtgcagagacagaacaagaggagaacttctggtctcaagcgctggaggatttggaaacctgcggacagtcaggaattctgagagaactggaggcaacaatcatgtcggggagcacgatgagtttgaatcatgaggctccaacacctcgcagtcagctggggcgacaggccagcttccaggagcgcagcagctcgcggccgcactacagccaaacaactcggagcaacaccctgccttcagatgtgggtaggaagtcagtaaccctgagaaaaatgaaacaagaaataaaggagatcatgtctccaactcctgtggagctgcacaaggtgaccttgtacaaggactctgacatggaggactttgggttcagtgtagcagatggcttactggagaaaggagtgtatgtcaaaaatattcgcccagctgggccaggagatcttggtggcttaaagccctatgacaggctcttacaggtgaatcatgtccgaaccagagactttgactgctgccttgttgtgcccctcatagcagaatccgggaataagctggacctggttattagtagaaacccactggcttcacagaagtctatagaccaacagagtctaccaggagattggagtgaacagaacagtgcttttttccagcagcctagccacggtggtaatttggagacacgagaacccactaatacattatagcaacgctttttataaagcaggacaaaagacaatatctacatggtgctaaaaatcctttaagatttctgtgacctttgaagcacagataatcaatcaacgtggcattaactgcaagcacaggggtcttttaaatctctctcatggctcatgttcacttcccttttcaagttgaagaggtttcttttttggtgacc

SEQ ID NO: 137407 - DNA, 662 bp, Homo sapiens
  Payload ID: 6903
  Gene Symbol: GRIP1
  Gene Name: glutamate receptor interacting protein 1
  ENST ID: ENST00000545666
  CDS Start-End: 31-662
acactttgccacagaaagcagtgagcaagaatgatagctgtctcttttaaatgccgttgtcaaattctgaggcgacttactaaagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgt

SEQ ID NO: 137408 - DNA, 573 bp, Homo sapiens
  Payload ID: 6903
  Gene Symbol: GRIP1
  Gene Name: glutamate receptor interacting protein 1
  ENST ID: ENST00000535002
  CDS Start-End: 1-233
actctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacagtgaaaattcagaggagcgacaggcaacttacctgggattcctgggccagcaaccacagcagccttcacaccaaccatcactataacacgtaccaccctgaccattgcagagtaccagccctgacattcccgaaagcacctcctccaaacagccctccagctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcattgtccttagcctccagcacagtaggattggctgggcaggttgttcacacagaaaccacagaggttgtgctgacggcagatcctgtcacaggatttgggatccaactgcagggc

SEQ ID NO: 137409 - DNA, 757 bp, Homo sapiens
  Payload ID: 6903
  Gene Symbol: GRIP1
  Gene Name: glutamate receptor interacting protein 1
  ENST ID: ENST00000540854
  CDS Start-End: 1-366
cttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatgggtgaatcatgtccgaaccagagactttgactgctgccttgttgtgcccctcatagcagaatccgggaataagctggacctggttattagtagaaacccactggcttcacagaagtctatagaccaacagagtctaccaggagattggagtgaacagaacagtgcttttttccagcagcctagccacggtggtaatttggagacacgagaacccactaatacattatagcaacgctttttataaagcaggacaaaagacaatatctacatggtgctaaaaatcctttaagatttctgtgacctttgaagcacagataatcaatcaacgtggcattaactgcaagcacaggggtcttttaaatctctctcatggctcatgttcacttcccttttcaagttgaagaggtttcttttttggtga

SEQ ID NO: 137410 - DNA, 524 bp, Homo sapiens
  Payload ID: 6903
  Gene Symbol: GRIP1
  Gene Name: glutamate receptor interacting protein 1
  ENST ID: ENST00000539540
  CDS Start-End: 163-524
aatcttaaatgcaaaaggtttctcagatggtgttctctgtgagcagtctatgagagtccctacactaaatccgccagccagacaaagccgcctgatggagcgttggctgtgaggagacagagcatcccagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatc

SEQ ID NO: 137411 - DNA, 848 bp, Homo sapiens
  Payload ID: 6903
  Gene Symbol: GRIP1
  Gene Name: glutamate receptor interacting protein 1
  ENST ID: ENST00000543172
  CDS Start-End: 1-848
tgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatggactctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatgctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcattgtccttagcctccagcacagtaggattggctgggcaggttgttcacacagaaaccacagaggttgtgctgacggcagatcctgtcacaggatttgggatccaactgcagggcagtgtgtttgccacagaaactctctcttctccacctctgatttcctatatcgaagctgacagcccagcagagagatgtg

SEQ ID NO: 137412 - DNA, 2491 bp, Homo sapiens
  Payload ID: 6903
  Gene Symbol: GRIP1
  Gene Name: glutamate receptor interacting protein 1
  ENST ID: ENST00000536215
  CDS Start-End: 130-2491
taaagtgatagtgcagaaagaagactggatgtggaatgagaactgaagttagagttttaagtcctcacaaaaggatttgcctgatacctgtccttagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatggactctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatgtgtccttagcctccagcacagtaggattggctgggcaggttgttcacacagaaaccacagaggttgtgctgacggcagatcctgtcacaggatttgggatccaactgcagggcagtgtgtttgccacagaaactctctcttctccacctctgatttcctatatcgaagctgacagcccagcagagagatgtggggtgctacagattggagacagagtgatggccatcaatggaattccaacagaagacagcaccttcgaagaagccagtcagctcctccgagactcttcaatcacgagcaaggtcacactggaaatcgagtttgatgttgcagagtctgtcatcccaagtagtggaacatttcatgtaaagctgcctaagaagcacaatgtggaacttggaataaccataagttcaccatccagtagaaaaccaggagaccccctcgtcatttcagatatcaagaaagggagtgtggcacacagaactgggaccctggaacttggggataaattgctcgcaatagataatatccggctggacaactgttccatggaagatgcagttcagatcctccagcaatgtgaagacctggtgaagctcaaaatccgcaaagatgaagataattcagatgagcaagaaagttccggagcaattatttacaccgtggagcttaaacgctacggggggccccttggcatcacaatttcaggaactgaagagccgtttgatcctataatcatttcaagcctcactaaagggggattagctgaaagaactggcgcaatccacataggagaccgaatcctagccatcaatagcagcagcttgaaagggaagcctctgagtgaagccatccatttgttacagatggcaggagagactgtcaccttgaaaattaagaaacagacagatgcccagtcagcatcgagccccaagaagttccctatttctagccatttgagtgacctgggggatgtggaggaggactcctcaccagcacagaagccaggcaagctctccgacatgtacccctccacggtgcccagtgtggacagtgctgtggattcatgggatgggtctgcaatagacaccagctatggaactcaaggcactagttttcaggcctcaggatacaatttcaacacctatgactggaggagtccaaaacagagaggcagcttgtccccagtcactaagcctcgaagccagacttacccagatgtggggctgagttatgaagactgggaccggtccacagccagtggttttgcaggggctgccgatagtgcagagacagaacaagaggagaacttctggtctcaagcgctggaggatttggaaacctgcggacagtcaggaattctgagagaactggaggcaacaatcatgtcggggagcacgatgagtttgaatcatgaggctccaacacctcgcagtcagctggggcgacaggccagcttccaggagcgcagcagctcgcggccgc

SEQ ID NO: 137413 - DNA, 2843 bp, Homo sapiens
  Payload ID: 6903
  Gene Symbol: GRIP1
  Gene Name: glutamate receptor interacting protein 1
  ENST ID: ENST00000540433
  CDS Start-End: 216-2843
agaagaggattaccacgagggctatgaggatgtctattattacgcttcagagcattttcgaagtaagcgcttctctccatcctccggttccttctcgcatgctggggctaacaataaaccttgtgtggagccttaatcttaaatgcaaaaggtttctcagatggtgttctctgtgagcagtctaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatggactctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatgcagctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcattgtccttagcctccagcacagtaggattggctgggcaggttgttcacacagaaaccacagaggttgtgctgacggcagatcctgtcacaggatttgggatccaactgcagggcagtgtgtttgccacagaaactctctcttctccacctctgatttcctatatcgaagctgacagcccagcagagagatgtggggtgctacagattggagacagagtgatggccatcaatggaattccaacagaagacagcaccttcgaagaagccagtcagctcctccgagactcttcaatcacgagcaaggtcacactggaaatcgagtttgatgttgcagagtctgtcatcccaagtagtggaacatttcatgtaaagctgcctaagaagcacaatgtggaacttggaataaccataagttcaccatccagtagaaaaccaggagaccccctcgtcatttcagatatcaagaaagggagtgtggcacacagaactgggaccctggaacttggggataaattgctcgcaatagataatatccggctggacaactgttccatggaagatgcagttcagatcctccagcaatgtgaagacctggtgaagctcaaaatccgcaaagatgaagataattcagatgagcaagaaagttccggagcaattatttacaccgtggagcttaaacgctacggggggccccttggcatcacaatttcaggaactgaagagccgtttgatcctataatcatttcaagcctcactaaagggggattagctgaaagaactggcgcaatccacataggagaccgaatcctagccatcaatagcagcagcttgaaagggaagcctctgagtgaagccatccatttgttacagatggcaggagagactgtcaccttgaaaattaagaaacagacagatgcccagtcagcatcgagccccaagaagttccctatttctagccatttgagtgacctgggggatgtggaggaggactcctcaccagcacagaagccaggcaagctctccgacatgtacccctccacggtgcccagtgtggacagtgctgtggattcatgggatgggtctgcaatagacaccagctatggaactcaaggcactagttttcaggcctcaggatacaatttcaacacctatgactggaggagtccaaaacagagaggcagcttgtccccagtcactaagcctcgaagccagacttacccagatgtggggctgagttatgaagactgggaccggtccacagccagtggttttgcaggggctgccgatagtgcagagacagaacaagaggagaacttctggtctcaagcgctggaggatttggaaacctgcggacagtcaggaattctgagagaactggaggagaaagctgacaggcgtgtgtctttgagaaacatgactctcttggcaacaatcatgtcggggagcacgatgagtttgaatcatgaggctccaacacctcgcagtcagctggggcgacaggccagcttccaggagcgcagcagctcgcggccgcactacagccaaacaactcggagcaacaccctgccttcagatgtgggtaggaagtcagtaaccctg

SEQ ID NO: 137414 - DNA, 3410 bp, Homo sapiens
  Payload ID: 6903
  Gene Symbol: GRIP1
  Gene Name: glutamate receptor interacting protein 1
  ENST ID: ENST00000538211
  CDS Start-End: 242-3410
gtgattgtgaagggggaggaggctgtggcaggcaggggtggtagtagtagtgaatgacacagatttgccagatgacatgtagcggacctctgcatcagccaagaggaattaagctttgtcactccccactgggactacctttctcctggtatgtgcgcaaggaattcatatgctgctgctgctgcagccaccagagcagagagccttgagtacactttgccacagaaagcagtgagcaagaatgatagctgtctcttttaaatgccgttgtcaaattctgaggcgacttactaaagatgagagtccctacactaaatccgccagccagacaaagccgcctgatggagcgttggctgtgaggagacagagcatcccagaggaattcaagggctccacagtcgtcgagctgatgaagaaggaaggcactaccctgggtctgacggtatcgggaggaattgataaggatggcaagccaagagtatctaatctgcggcaaggaggaattgctgctagaagtgaccagctggatgtgggtgactacatcaaagcagtgaatggaatcaacctggccaaattccgccatgacgagatcatcagcttgctgaagaatgtgggagaaagagtggttcttgaagtagagtacgagcttccaccggtctctgtgcaaggatcaagtgttattttccgaacagtggaggtcacattacataaagaaggcaatacctttggttttgtaattcgagggggagcacatgatgatagaaataaatctcgtccagttgtgataacatgtgttcgtcctggagggcctgctgacagagagggcacgatcaaacccggtgacaggttgctcagtgtggatggaattcggcttcttggaactacgcatgctgaagccatgagtattcttaaacaatgtggacaagaagcagcactgctgatagaatatgatgtctcagtaatggactctgtggcaacagcatccgggccactactagtcgaagttgccaaaactcctggtgccagccttggggttgccctaactacctcgatgtgctgtaacaaacaagtcattgtcatagacaaaatcaaatctgcaagtattgcagacagatgtggcgcattgcatgtgggagatcacatcctctccatcgatggaaccagcatggagtactgtacacttgcagaagcaacccagttcctggccaacaccactgaccaggtcaagcttgagatccttccccatcatcagacccggctggccctaaaggggcccgaccatgcagctttggtgtcttcatccttctctcctacctccatgagtgcatacagcctgagttccctgaacatggggactctacctcgaagcctctactccaccagcccacgtggaaccatgatgaggaggagactgaaaaagaaagacttcaaaagctcattgtccttagcctccagcacagtaggattggctgggcaggttgttcacacagaaaccacagaggttgtgctgacggcagatcctgtcacaggatttgggatccaactgcagggcagtgtgtttgccacagaaactctctcttctccacctctgatttcctatatcgaagctgacagcccagcagagagatgtggggtgctacagattggagacagagtgatggccatcaatggaattccaacagaagacagcaccttcgaagaagccagtcagctcctccgagactcttcaatcacgagcaaggtcacactggaaatcgagtttgatgttgcagagtctgtcatcccaagtagtggaacatttcatgtaaagctgcctaagaagcacaatgtggaacttggaataaccataagttcaccatccagtagaaaaccaggagaccccctcgtcatttcagatatcaagaaagggagtgtggcacacagaactgggaccctggaacttggggataaattgctcgcaatagataatatccggctggacaactgttccatggaagatgcagttcagatcctccagcaatgtgaagacctggtgaagctcaaaatccgcaaagatgaagataattcagatgagcaagaaagttccggagcaattatttacaccgtggagcttaaacgctacggggggccccttggcatcacaatttcaggaactgaagagccgtttgatcctataatcatttcaagcctcactaaagggggattagctgaaagaactggcgcaatccacataggagaccgaatcctagccatcaatagcagcagcttgaaagggaagcctctgagtgaagccatccatttgttacagatggcaggagagactgtcaccttgaaaattaagaaacagacagatgcccagtcagcatcgagccccaagaagttccctatttctagccatttgagtgacctgggggatgtggaggaggactcctcaccagcacagaagccaggcaagctctccgacatgtacccctccacggtgcccagtgtggacagtgctgtggattcatgggatgggtctgcaatagacaccagctatggaactcaaggcactagttttcaggcctcaggatacaatttcaacacctatgactggaggagtccaaaacagagaggcagcttgtccccagtcactaagcctcgaagccagacttacccagatgtggggctgagttatgaagactgggaccggtccacagccagtggttttgcaggggctgccgatagtgcagagacagaacaagaggagaacttctggtctcaagcgctggaggatttggaaacctgcggacagtcaggaattctgagagaactggaggcaacaatcatgtcggggagcacgatgagtttgaatcatgaggctccaacacctcgcagtcagctggggcgacaggccagcttccaggagcgcagcagctcgcggccgcactacagccaaacaactcggagcaacaccctgccttcagatgtgggtaggaagtcagtaaccctgagaaaaatgaaacaagaaataaaggagatcatgtctccaactcctgtggagctgcacaaggtgaccttgtacaaggactctgacatggaggactttgggttcagtgtagcagatggcttactggagaaaggagtgtatgtcaaaaatattcgcccagctgggccaggagatcttggtggcttaaagccctatgacaggctcttacaggtgaatcatgtccgaaccagagactttgactgctgccttgttgtgcccctcatagcagaatccgggaataagctggacctggttattagtagaaacccactggcttcacagaagtctatagaccaacagagtctaccaggagattggagtgaacagaacagtgcttttttccagcagcctagccacggtggtaatttggagacacgagaac

SEQ ID NO: 137415 - DNA, 600 bp, Homo sapiens
  Payload ID: 6903
  Gene Symbol: GRIP1
  Gene Name: glutamate receptor interacting protein 1
  ENST ID: ENST00000538373
  CDS Start-End: 554-600
gatggaccgcttcctgggttttgtcaaggcgataagaagatctaggagaagaaaggggaaaaagtaccgaccagaagaggattaccacgagggctatgaggatgtctattattacgcttcagagcattttcgaaagtctcgctctgttgcccgggctggagtgtggtggcttgatcctggttcaacctctgcctcccaggttcaaggagtctcgtgcctcagcctcctaagtacctgggattacagagtcatttctacagaaagaagcaggactgtttctcatcaggattctatgctcgtgtccagaactgtgaaatgaggagtggtgacgctgactatacctccttttaattgagacagtaaggccttctcaccttccccagcttactggggatgggaacagaacataagacaccagcagaaagagaagccaagagaaaatgagagtccctacactaaatccgccagccagacaaagccgcctgatggagcgttggctgtgaggagacagagcatcccagaggaattcaagggctccacagtcgtcgagctgatgaagaaggaaggcactaccctgggtctgacggtatcgggaggaat

SEQ ID NO: 137416 - DNA, 7752 bp, Homo sapiens
  Payload ID: 6904
  Gene Symbol: GRIP2
  Gene Name: glutamate receptor interacting protein 2
  ENST ID: ENST00000621039
  CDS Start-End: 67-3198
ggagggagggccaagcagcgtggctcccgagggagttggtgggcagcaggggagacaatagcgaacatgctgtgtgggctcagccgggagacccctggagaggcggacgatgggccctactccaaaggaggcaaggacgcaggaggggccgacgtttccctggcgtgccgcagacagagcattccagaggagttccgagggatcactgtggtggagctgatcaagaaagaaggcagcacgctgggcctgactatctcaggtggcaccgacaaggatggaaagcccagggtctccaacctgagacctgggggacttgcagccaggagtgatctgctgaacattggtgactatattcggtctgtgaacgggatccacctgaccaggctccgccacgatgagatcatcaccctgctcaagaatgtgggcgagcgcgtggtgctggaggtggagtatgagctgcccccgcccgctcctgagaataaccccaggatcatttcaaagacagtggacgtctccctctacaaggagggcaatagctttggctttgtccttagaggaggtgcccatgaagatgggcacaagtcccgcccgcttgtcctgacctacgtgcggcccggtggccctgccgacagggagggctccctgaaggtgggcgacaggctgctcagtgtcgatggaatcccgctgcacggggccagccatgccaccgccctggccaccctgcggcagtgcagccacgaggcactctttcaggtggagtatgatgtggccacccctgacacggtggctaatgcttcgggacccttgatggtggaaatagtcaagacgccagggtctgccctggggatctcgctcaccaccacctccctccggaacaagtcagtcattaccatcgaccgcatcaagccagccagcgtggtggacaggagcggagccctgcaccctggagaccacatcctgtccatcgatggcaccagcatggaacactgctcgctgcttgaggccaccaagctcctggccagcatttcagagaaggtgcggctggagatcctgcctgtgccccagagtcagcggccactgaggccctcagaggcagtgaaagtgcagaggagtgagcagctgcaccgctgggacccctgcgtgccctcctgccacagcccccggcccggccactgcaggatgcccacctgggccacacctgctggccaggaccaaagccgatccttgtcttcaactcccttttcctcgccgaccttgaaccacgccttttcctgcaacaaccccagcacccttccccgtggatcccagcccatgagtcctcgaactacaatggggcggaggaggcagcgaagaagggaacacaagagctcgttgtcgctagcctccagcacggtggggccgggcgggcagattgtgcacacggagaccacggaggtcgtgctctgtggagaccccctcagcggctttggcctccagctccagggcggcatcttcgccaccgagaccctgtcctccccacccctcgtgtgcttcatcgagcctgacagtccggctgagaggtgtgggctgctgcaggtgggggaccgtgtcctgtccatcaatggcattgccaccgaggacgggactatggaggaagccaaccagctcctgcgggacgccgcactggcccacaaggtcgtgctggaggtggagttcgatgtggcggagtccgtcatcccaagcagtggcaccttccacgtgaagctgcccaagaagcgcagcgtggagctgggcatcaccatcagctcggccagcaggaaacgaggggagcccttgatcatctccgacatcaagaaaggcagcgtggcacacaggacgggcaccctggagccaggcgacaagctactggccattgacaatatccgcctggacaactgccccatggaggacgccgtgcaaatcctgcggcagtgcgaggacctggtgaagctgaagatccggaaggacgaggacaactctgatgagctggagaccacaggtgccgtcagttacacagtggagctgaagcgctacgggggtcccctgggcatcaccatttcgggcacggaggaaccttttgaccccattgtcatctcaggcctcaccaagcgtggcctggctgagaggactggtgccatccacgtgggggaccgcattctggccatcaacaacgttagcctcaagggccggccgctgagcgaggccatccacctcctgcaggtggctggagagaccgtcacactgaagatcaagaagcaactagaccgtcccctcctaccccgcaagtcgggcagcctcagtgagaccagtgatgctgatgaggacccagcagatgccctgaaaggaggcctgccagcagcccgcttctcgccggctgtgcccagtgtggacagtgctgtggagtcttgggacagctcggccaccgagggtggctttgggggcccagggtcctatacaccacaggcagcagcccggggcacgaccccccaggagcggaggcctggctggctgaggggcagccccccacccaccgagccccggaggacgagctataccccaaccccagctgacgagagctttccagaggaggaggaggaggatgattgggagccgccaacgagcccagcccctggccctgcccgagaggagggcttctggcgcatgtttggagaagctctcgaagacctggagtcatgtggtcagtcagagctgctgagggaactggaggcatccatcatgacgggcaccgtgcagagggtggccctcgagggcaggcctggccaccggccttggcagaggggccgggaggtacgagcctctcctgcagaaatggaggagctgttgctgcctacacccttggagatgcacaaggtgaccctgcacaaggaccccatgcggcatgactttggtttcagcgtctcagatggcctcctggaaaaaggtgtctatgtccacactgtgcgccctgatgggccagcccaccgtggaggcctccagcccttcgacagggtcctgcaggtcaaccacgtccgtacacgggacttcgactgctgcctggcggtgccactcctggccgaggcgggtgatgtcttggagctgatcatcagccgcaagccgcacacggcacacagcagccgggccccccgatcgccaggccccagcagtccccggatgctctgaagtcagcatgtgggccgaactcctaaggggccacccaggcagatcctggctcccagacacgtagctgggctggagaagcggccacccactcattcatctgttggtctggcagactctgagcctgggatgatgcttggtctctgttccccaggtctgtggtgactggggtgccaggcagggaggtcctgccctagttggagtgacagctggggtctctcgccaagttgggtctccaagatgcccagaggagcctcccttaagaagggttggcacaggctgctcagccgagaggagagaggcctgggggctgtcccaggtctctgtggggcctccttggagaggtcgaagatgtagggagcacttcctcccagcaaagccatggagctggaatgagctgcaaggaggagtgagttctcggtcacaggaggtgagcaggcaggagctggataccccagcgcagtcatgcattggggtatgaggcattcccatgatgcgtgcacacgcgcttgggggttggcttcctgatggggagccacttcatctagagactcggccaccaggaaggatgctgcttcggatgggagcccagctccttcgcttctccagaataggggtttggggcttgctagtcctgagattctgagattcccagaatctggtccccacttatgagactcttaagttggggcgtctgggatcccaggaagtgctggccctttgattctgaaagtgggtgattctttgatttcagcatctcagtctgaagcttctgggacttgagactgtggttctgggcccattgggcaggctctatgggccttgggctctcagccctcctgcttcttctgtaggccgtgtggccactgacccatctgcacgtccgctcagcccaagcccctccatgtgggaggggtcattttggggcaaaagaccctggagcttccattcacctgccatccagtgaaaattgaaaagcgatggacgcaggacctgtgaggcggtagcgctcctctttacagccagatcagtggaggaagaggagaaagagggagggagatgggagagaaatgggccagagaaaaagatgggacactcttgcccagtggagggtgtccaaagtgcttattcaaagaagtctattcccacttgaaatctggaagcaccagcatcccttaaaatcattgtcctcagtgtccacaaatcagagaccctcttcattttgagaagggtgtgggcctcccctggtggtctagtgagtggtgcctgggatggagtgggcgggcaggtgtagccagggctggggatgtgctttgcctggcccagttctcacaggggtctcaggaaaacggggcacccactcccacctccatctgtctccaacctggggtccctggaggccagaaaagtgctcttccatttgagggaacagatgaggagtcaagaggtctgttcttttcaccctgggtctgttacctgtttgctgtgtgaccctgtctgggttggacccccagcccctctggacgatcacgggtggacagtctgagcagacacaggcctcctggtcagggccggaaccatctctgccgacccaccaaggcccccttggggacctgcccacgctgtctcctggaggcctgcctcccttacccctcccctccacttcgctgggctctgccccttggtgccctccctgagggccctgcatgcttgtgcctggggtgctcagcgcctctgctatcttggattcccgtgtactcagcccagagtgaaagggcactgtctacctgtcacagggcaccaagtgaaagccaagagccctcacttttgagggtgagggacagcacagcagaggtgtggcttctggatgcaagcagccatagctgtgtgaccttggacaggtggctcagcctctctggacctctgctaagcaacagggctggacaggacacactctcagggcctctcggcttgggaaaactgcattgactccaggactccaggcgagggaagatgcacccgactctaactaatacccccctccctcctcgggctgaggcctctgccattctcccaaaagtatgcaatcaggcccgcggtgggcctcccagccatgccggcctcctcatatgcaatatttcttctggcttctcatggggatggttcatccccgacttgaaatttcctgacacctttccccagtgagcgccctgcctgcctatgcattttgggaacagcccctgtgacatgtccccttccacctgccctctcccccaaagctgtatttttctctggctgagattagaacacattccttgtaaagtatttttctacatcgggttttcttagggctctcgggaagcacaaggggctgtattgcaaaggccgcttatggtctgtttggggccctcgtctaagtctttgtcccaccaggggttgcagtggcttgggggtaggtgccatggggatgattttttaaaataaaattatttaaatccacctagagtagaagtttgctttttaaaaaaatcatggattggcaagagtcagcttctgtatgggtctggtgacatctcacctgcttttgatgattcattaattcaaaaagtttgccatttgcttccatcatccagcccctgggcaacatgaatcagacagatttaggtcatgtctgcacattctggtggcaggcagacaatcaacaagtaagcaaataaataattatttcaaaaggcatcaagtgcaacaaagaaaacaagggagtaacgggatagagggaccagggtgaggggctttagctcacaatattaggaggggtttctctcaagaggcgacatttgcaatgagacctgaagacaggagccagcctccatggagacctggaggaagagtgtctcaggcagcgggcacagctagtgcaaaggccctgagataggaacgagtttgacggtctcaaggaagagaaagaaggcctgggaggggaatggggctggagactaggttggaggtagcaggaatcagtcgtgaaggcttgggtagggggagcaaatttgattctctgcgcagcagaaagccagaggcaggcagtggtgcctgcatatggagtctctttagcccaggttgggaaggtagtggcaggagggcagcctcaggtctggctgctgccctggagtgtccagagagtgtctagggcaggtgagctacagggtctgggacccagaggccagggccaggccccactggggaggccacagttctgtgagcagaggaagagcttctttccaggaagcgagtactctgtcttgggagtggtgtaggcagggggaaggccaagggaggcagcaggccttgctctaagcgctttgcaagagcttgctggatcctcccaatagcctttggaggtgggctctattcctgtcccatcattacagatgaggaaacaggcacagagaggttacgtaatttgcccaagtccacacaggtagtaagggatggaaccagggcttgaacacaagccacatggcccagtacacatagagagaggcaggcaggtaggcataggctgtcagaaagagccagaaaatgggggtagggtggtcttctattctaacattgtctataaatgagttactgagaattttgtctggttagttgggcaaagggctcaactgactcccgagtttgtccatcccaaagggtggggggcgctgttggcaggaaggctgccccaaacatggacctgttgtgaccccagagagcccctaactgggtattaatgagcgcctgcacctgacggtgggggagtgggagaagggcaatcaggtttgctccccctctaccctttcccccactccgccacccgctttctgcccttctggcaggtcagcccaaggctaaagaggagggactgaaagccgcagcaggtgagcacctaaggccaagagcatcacctccaatcatcctggtggccttgatggggacaatggtttattccagatggggaaactgaggctcaggtgactgctgccagatctcccagctgtacagggctgggcatgtagcaggtagaatcagtagagccagtagagccaagagctcatgggcccgggtgcgaatccaggttctttcatggacttgctgtgtacccctgagtgagcaagctgcttcctctgtgagcctccatgtgggaacctctaacctgggaaaatacctacctttgaggagcgtcctgggattggacgggaagccctttataaaatgtaaagcgtttggcaaacgttgagggggaaatacctcaccagaacacaacccacacatgttggatgttaaaaaggaaatgtttattttcatgttataaggtgattacaaactcctctaaaaaaagcaaagatgaatttaaaatattgatatacatatttatctaaaaagcaaaagagaaaaaaacccctgcaaaatacagggaatcatatcataaaacatttatacacaaaagcttgtatactgcaagactgaactacacaccaaggatcttgttcaaatacaaatgttcctcctcag

SEQ ID NO: 137417 - DNA, 7977 bp, Homo sapiens
  Payload ID: 6904
  Gene Symbol: GRIP2
  Gene Name: glutamate receptor interacting protein 2
  ENST ID: ENST00000619221
  CDS Start-End: 1-3423
atgcgcctgtcctccctgactgaagaggctgtagatggagggaatggaggcgagtggggtgaggatctgttagagcagttcacatgcattccttcccgcgtggttgaagctaagactgctccagagtggcctctgtgccctggtgaaggccagggtcttcatggcgagcctctccctgaccactgccagggtaccggtggccaaattgacccctccctggggaggggagggagggccaagcagcgtggctcccgagggagttggtgggcagcaggggagacaatagcgaacatgctgtgtgggctcagccgggagacccctggagaggcggacgatgggccctactccaaaggaggcaaggacgcaggaggggccgacgtttccctggcgtgccgcagacagagcattccagaggagttccgagggatcactgtggtggagctgatcaagaaagaaggcagcacgctgggcctgactatctcaggtggcaccgacaaggatggaaagcccagggtctccaacctgagacctgggggacttgcagccaggagtgatctgctgaacattggtgactatattcggtctgtgaacgggatccacctgaccaggctccgccacgatgagatcatcaccctgctcaagaatgtgggcgagcgcgtggtgctggaggtggagtatgagctgcccccgcccgctcctgagaataaccccaggatcatttcaaagacagtggacgtctccctctacaaggagggcaatagctttggctttgtccttagaggaggtgcccatgaagatgggcacaagtcccgcccgcttgtcctgacctacgtgcggcccggtggccctgccgacagggagggctccctgaaggtgggcgacaggctgctcagtgtcgatggaatcccgctgcacggggccagccatgccaccgccctggccaccctgcggcagtgcagccacgaggcactctttcaggtggagtatgatgtggccacccctgacacggtggctaatgcttcgggacccttgatggtggaaatagtcaagacgccagggtctgccctggggatctcgctcaccaccacctccctccggaacaagtcagtcattaccatcgaccgcatcaagccagccagcgtggtggacaggagcggagccctgcaccctggagaccacatcctgtccatcgatggcaccagcatggaacactgctcgctgcttgaggccaccaagctcctggccagcatttcagagaaggtgcggctggagatcctgcctgtgccccagagtcagcggccactgaggccctcagaggcagtgaaagtgcagaggagtgagcagctgcaccgctgggacccctgcgtgccctcctgccacagcccccggcccggccactgcaggatgcccacctgggccacacctgctggccaggaccaaagccgatccttgtcttcaactcccttttcctcgccgaccttgaaccacgccttttcctgcaacaaccccagcacccttccccgtggatcccagcccatgagtcctcgaactacaatggggcggaggaggcagcgaagaagggaacacaagagctcgttgtcgctagcctccagcacggtggggccgggcgggcagattgtgcacacggagaccacggaggtcgtgctctgtggagaccccctcagcggctttggcctccagctccagggcggcatcttcgccaccgagaccctgtcctccccacccctcgtgtgcttcatcgagcctgacagtccggctgagaggtgtgggctgctgcaggtgggggaccgtgtcctgtccatcaatggcattgccaccgaggacgggactatggaggaagccaaccagctcctgcgggacgccgcactggcccacaaggtcgtgctggaggtggagttcgatgtggcggagtccgtcatcccaagcagtggcaccttccacgtgaagctgcccaagaagcgcagcgtggagctgggcatcaccatcagctcggccagcaggaaacgaggggagcccttgatcatctccgacatcaagaaaggcagcgtggcacacaggacgggcaccctggagccaggcgacaagctactggccattgacaatatccgcctggacaactgccccatggaggacgccgtgcaaatcctgcggcagtgcgaggacctggtgaagctgaagatccggaaggacgaggacaactctgatgagctggagaccacaggtgccgtcagttacacagtggagctgaagcgctacgggggtcccctgggcatcaccatttcgggcacggaggaaccttttgaccccattgtcatctcaggcctcaccaagcgtggcctggctgagaggactggtgccatccacgtgggggaccgcattctggccatcaacaacgttagcctcaagggccggccgctgagcgaggccatccacctcctgcaggtggctggagagaccgtcacactgaagatcaagaagcaactagaccgtcccctcctaccccgcaagtcgggcagcctcagtgagaccagtgatgctgatgaggacccagcagatgccctgaaaggaggcctgccagcagcccgcttctcgccggctgtgcccagtgtggacagtgctgtggagtcttgggacagctcggccaccgagggtggctttgggggcccagggtcctatacaccacaggcagcagcccggggcacgaccccccaggagcggaggcctggctggctgaggggcagccccccacccaccgagccccggaggacgagctataccccaaccccagctgacgagagctttccagaggaggaggaggaggatgattgggagccgccaacgagcccagcccctggccctgcccgagaggagggcttctggcgcatgtttggagaagctctcgaagacctggagtcatgtggtcagtcagagctgctgagggaactggaggcatccatcatgacgggcaccgtgcagagggtggccctcgagggcaggcctggccaccggccttggcagaggggccgggaggtacgagcctctcctgcagaaatggaggagctgttgctgcctacacccttggagatgcacaaggtgaccctgcacaaggaccccatgcggcatgactttggtttcagcgtctcagatggcctcctggaaaaaggtgtctatgtccacactgtgcgccctgatgggccagcccaccgtggaggcctccagcccttcgacagggtcctgcaggtcaaccacgtccgtacacgggacttcgactgctgcctggcggtgccactcctggccgaggcgggtgatgtcttggagctgatcatcagccgcaagccgcacacggcacacagcagccgggccccccgatcgccaggccccagcagtccccggatgctctgaagtcagcatgtgggccgaactcctaaggggccacccaggcagatcctggctcccagacacgtagctgggctggagaagcggccacccactcattcatctgttggtctggcagactctgagcctgggatgatgcttggtctctgttccccaggtctgtggtgactggggtgccaggcagggaggtcctgccctagttggagtgacagctggggtctctcgccaagttgggtctccaagatgcccagaggagcctcccttaagaagggttggcacaggctgctcagccgagaggagagaggcctgggggctgtcccaggtctctgtggggcctccttggagaggtcgaagatgtagggagcacttcctcccagcaaagccatggagctggaatgagctgcaaggaggagtgagttctcggtcacaggaggtgagcaggcaggagctggataccccagcgcagtcatgcattggggtatgaggcattcccatgatgcgtgcacacgcgcttgggggttggcttcctgatggggagccacttcatctagagactcggccaccaggaaggatgctgcttcggatgggagcccagctccttcgcttctccagaataggggtttggggcttgctagtcctgagattctgagattcccagaatctggtccccacttatgagactcttaagttggggcgtctgggatcccaggaagtgctggccctttgattctgaaagtgggtgattctttgatttcagcatctcagtctgaagcttctgggacttgagactgtggttctgggcccattgggcaggctctatgggccttgggctctcagccctcctgcttcttctgtaggccgtgtggccactgacccatctgcacgtccgctcagcccaagcccctccatgtgggaggggtcattttggggcaaaagaccctggagcttccattcacctgccatccagtgaaaattgaaaagcgatggacgcaggacctgtgaggcggtagcgctcctctttacagccagatcagtggaggaagaggagaaagagggagggagatgggagagaaatgggccagagaaaaagatgggacactcttgcccagtggagggtgtccaaagtgcttattcaaagaagtctattcccacttgaaatctggaagcaccagcatcccttaaaatcattgtcctcagtgtccacaaatcagagaccctcttcattttgagaagggtgtgggcctcccctggtggtctagtgagtggtgcctgggatggagtgggcgggcaggtgtagccagggctggggatgtgctttgcctggcccagttctcacaggggtctcaggaaaacggggcacccactcccacctccatctgtctccaacctggggtccctggaggccagaaaagtgctcttccatttgagggaacagatgaggagtcaagaggtctgttcttttcaccctgggtctgttacctgtttgctgtgtgaccctgtctgggttggacccccagcccctctggacgatcacgggtggacagtctgagcagacacaggcctcctggtcagggccggaaccatctctgccgacccaccaaggcccccttggggacctgcccacgctgtctcctggaggcctgcctcccttacccctcccctccacttcgctgggctctgccccttggtgccctccctgagggccctgcatgcttgtgcctggggtgctcagcgcctctgctatcttggattcccgtgtactcagcccagagtgaaagggcactgtctacctgtcacagggcaccaagtgaaagccaagagccctcacttttgagggtgagggacagcacagcagaggtgtggcttctggatgcaagcagccatagctgtgtgaccttggacaggtggctcagcctctctggacctctgctaagcaacagggctggacaggacacactctcagggcctctcggcttgggaaaactgcattgactccaggactccaggcgagggaagatgcacccgactctaactaatacccccctccctcctcgggctgaggcctctgccattctcccaaaagtatgcaatcaggcccgcggtgggcctcccagccatgccggcctcctcatatgcaatatttcttctggcttctcatggggatggttcatccccgacttgaaatttcctgacacctttccccagtgagcgccctgcctgcctatgcattttgggaacagcccctgtgacatgtccccttccacctgccctctcccccaaagctgtatttttctctggctgagattagaacacattccttgtaaagtatttttctacatcgggttttcttagggctctcgggaagcacaaggggctgtattgcaaaggccgcttatggtctgtttggggccctcgtctaagtctttgtcccaccaggggttgcagtggcttgggggtaggtgccatggggatgattttttaaaataaaattatttaaatccacctagagtagaagtttgctttttaaaaaaatcatggattggcaagagtcagcttctgtatgggtctggtgacatctcacctgcttttgatgattcattaattcaaaaagtttgccatttgcttccatcatccagcccctgggcaacatgaatcagacagatttaggtcatgtctgcacattctggtggcaggcagacaatcaacaagtaagcaaataaataattatttcaaaaggcatcaagtgcaacaaagaaaacaagggagtaacgggatagagggaccagggtgaggggctttagctcacaatattaggaggggtttctctcaagaggcgacatttgcaatgagacctgaagacaggagccagcctccatggagacctggaggaagagtgtctcaggcagcgggcacagctagtgcaaaggccctgagataggaacgagtttgacggtctcaaggaagagaaagaaggcctgggaggggaatggggctggagactaggttggaggtagcaggaatcagtcgtgaaggcttgggtagggggagcaaatttgattctctgcgcagcagaaagccagaggcaggcagtggtgcctgcatatggagtctctttagcccaggttgggaaggtagtggcaggagggcagcctcaggtctggctgctgccctggagtgtccagagagtgtctagggcaggtgagctacagggtctgggacccagaggccagggccaggccccactggggaggccacagttctgtgagcagaggaagagcttctttccaggaagcgagtactctgtcttgggagtggtgtaggcagggggaaggccaagggaggcagcaggccttgctctaagcgctttgcaagagcttgctggatcctcccaatagcctttggaggtgggctctattcctgtcccatcattacagatgaggaaacaggcacagagaggttacgtaatttgcccaagtccacacaggtagtaagggatggaaccagggcttgaacacaagccacatggcccagtacacatagagagaggcaggcaggtaggcataggctgtcagaaagagccagaaaatgggggtagggtggtcttctattctaacattgtctataaatgagttactgagaattttgtctggttagttgggcaaagggctcaactgactcccgagtttgtccatcccaaagggtggggggcgctgttggcaggaaggctgccccaaacatggacctgttgtgaccccagagagcccctaactgggtattaatgagcgcctgcacctgacggtgggggagtgggagaagggcaatcaggtttgctccccctctaccctttcccccactccgccacccgctttctgcccttctggcaggtcagcccaaggctaaagaggagggactgaaagccgcagcaggtgagcacctaaggccaagagcatcacctccaatcatcctggtggccttgatggggacaatggtttattccagatggggaaactgaggctcaggtgactgctgccagatctcccagctgtacagggctgggcatgtagcaggtagaatcagtagagccagtagagccaagagctcatgggcccgggtgcgaatccaggttctttcatggacttgctgtgtacccctgagtgagcaagctgcttcctctgtgagcctccatgtgggaacctctaacctgggaaaatacctacctttgaggagcgtcctgggattggacgggaagccctttataaaatgtaaagcgtttggcaaacgttgagggggaaatacctcaccagaacacaacccacacatgttggatgttaaaaaggaaatgtttattttcatgttataaggtgattacaaactcctctaaaaaaagcaaagatgaatttaaaatattgatatacatatttatctaaaaagcaaaagagaaaaaaacccctgcaaaatacagggaatcatatcataaaacatttatacacaaaagcttgtatactgcaagactgaactacacaccaaggatcttgttcaaatacaaatgttcctcctcag

SEQ ID NO: 137418 - DNA, 4271 bp, Homo sapiens
  Payload ID: 6904
  Gene Symbol: GRIP2
  Gene Name: glutamate receptor interacting protein 2
  ENST ID: ENST00000430219
  CDS Start-End: 1-984
gagtccgtcatcccaagcagtggcaccttccacgtgaagctgcccaagaagcgcagcgtggagctgggcatcaccatcagctcggccagcaggaaacgaggggagcccttgatcatctccgacatcaagaaaggcagcgtggcacacaggacgggcaccctggagccaggcgacaagctactggccattgacaatatccgcctggacaactgccccatggaggacgccgtgcaaatcctgcggcagtgcgaggacctggtgaagctgaagatccggaaggacgaggacaactctgatgagctggagaccacaggtgccgtcagttacacagtggagctgaagcgctacgggggtcccctgggcatcaccatttcgggcacggaggaaccttttgaccccattgtcatctcaggcctcaccaagcgtggcctggctgagaggactggtgccatccacgtgggggaccgcattctggccatcaacaacgttagcctcaagggccggccgctgagcgaggccatccacctcctgcaggtggctggagagaccgtcacactgaagatcaagaagcaactagaccgtcccctcctaccccgcaagtcgggcagcctcagtgagaccagtgatgctgatgaggacccagcagatgccctgaaaggaggcctgccagcagcccgcttctcgccggctgtgcccagtgtggacagtgctgtggagtcttgggacagctcggccaccgagggtggctttgggggcccagggtcctatacaccacaggcagcagcccggggcacgaccccccaggagcggaggcctggctggctgaggggcagccccccacccaccgagccccggaggacgagctataccccaaccccagctgacgagagctttccagaggaggaggaggaggatgattgggagccgccaacgaggcatcctgtgtcaccgctctccaccccgtctcatctgcccctgttctaactggccaccgacagtcctggtcgcccctaactgcgtctttcccctattccgtgtcaccaaccactgccccggggccccagaactgccaccgaggacgcccgcctgcctgcccgcccacccaccctatggcccctcgagcccaacgctgggccctggggccccgaagactcctcaggccccagcccgcccacccgcctgccaggagttgacgctctctggttcctacgttacagcccagcccctggccctgcccgagaggagggcttctggcgcatgtttggagaagctctcgaagacctggagtcatgtggtcagtcagagctgctgagggaactggaggcatccatcatgacgggcaccgtgcagagggtggccctcgagggcaggcctggccaccggccttggcagaggggccgggaggtacgagcctctcctgcagaaatggaggagctgttgctgcctacacccttggagatgcacaaggtgaccctgcacaaggaccccatgcggcatgactttggtttcagcgtctcagatggcctcctggaaaaaggtgtctatgtccacactgtgcgccctgatgggccagcccaccgtggaggcctccagcccttcgacagggtcctgcaggtcaaccacgtccgtacacgggacttcgactgctgcctggcggtgccactcctggccgaggcgggtgatgtcttggagctgatcatcagccgcaagccgcacacggcacacagcagccgggccccccgatcgccaggccccagcagtccccggatgctctgaagtcagcatgtgggccgaactcctaaggggccacccaggcagatcctggctcccagacacgtagctgggctggagaagcggccacccactcattcatctgttggtctggcagactctgagcctgggatgatgcttggtctctgttccccaggtctgtggtgactggggtgccaggcagggaggtcctgccctagttggagtgacagctggggtctctcgccaagttgggtctccaagatgcccagaggagcctcccttaagaagggttggcacaggctgctcagccgagaggagagaggcctgggggctgtcccaggtctctgtggggcctccttggagaggtcgaagatgtagggagcacttcctcccagcaaagccatggagctggaatgagctgcaaggaggagtgagttctcggtcacaggaggtgagcaggcaggagctggataccccagcgcagtcatgcattggggtatgaggcattcccatgatgcgtgcacacgcgcttgggggttggcttcctgatggggagccacttcatctagagactcggccaccaggaaggatgctgcttcggatgggagcccagctccttcgcttctccagaataggggtttggggcttgctagtcctgagattctgagattcccagaatctggtccccacttatgagactcttaagttggggcgtctgggatcccaggaagtgctggccctttgattctgaaagtgggtgattctttgatttcagcatctcagtctgaagcttctgggacttgagactgtggttctgggcccattgggcaggctctatgggccttgggctctcagccctcctgcttcttctgtaggccgtgtggccactgacccatctgcacgtccgctcagcccaagcccctccatgtgggaggggtcattttggggcaaaagaccctggagcttccattcacctgccatccagtgaaaattgaaaagcgatggacgcaggacctgtgaggcggtagcgctcctctttacagccagatcagtggaggaagaggagaaagagggagggagatgggagagaaatgggccagagaaaaagatgggacactcttgcccagtggagggtgtccaaagtgcttattcaaagaagtctattcccacttgaaatctggaagcaccagcatcccttaaaatcattgtcctcagtgtccacaaatcagagaccctcttcattttgagaagggtgtgggcctcccctggtggtctagtgagtggtgcctgggatggagtgggcgggcaggtgtagccagggctggggatgtgctttgcctggcccagttctcacaggggtctcaggaaaacggggcacccactcccacctccatctgtctccaacctggggtccctggaggccagaaaagtgctcttccatttgagggaacagatgaggagtcaagaggtctgttcttttcaccctgggtctgttacctgtttgctgtgtgaccctgtctgggttggacccccagcccctctggacgatcacgggtggacagtctgagcagacacaggcctcctggtcagggccggaaccatctctgccgacccaccaaggcccccttggggacctgcccacgctgtctcctggaggcctgcctcccttacccctcccctccacttcgctgggctctgccccttggtgccctccctgagggccctgcatgcttgtgcctggggtgctcagcgcctctgctatcttggattcccgtgtactcagcccagagtgaaagggcactgtctacctgtcacagggcaccaagtgaaagccaagagccctcacttttgagggtgagggacagcacagcagaggtgtggcttctggatgcaagcagccatagctgtgtgaccttggacaggtggctcagcctctctggacctctgctaagcaacagggctggacaggacacactctcagggcctctcggcttgggaaaactgcattgactccaggactccaggcgagggaagatgcacccgactctaactaatacccccctccctcctcgggctgaggcctctgccattctcccaaaagtatgcaatcaggcccgcggtgggcctcccagccatgccggcctcctcatatgcaatatttcttctggcttctcatggggatggttcatccccgacttgaaatttcctgacacctttccccagtgagcgccctgcctgcctatgcattttgggaacagcccctgtgacatgtccccttccacctgccctctcccccaaagctgtatttttctctggctgagattagaacacattccttgtaaagtatttttctacatcgggttttcttagggctctcgggaagcacaaggggctgtattgcaaaggccgcttatggtctgtttggggccctcgtctaagtctttgtcccaccaggggttgcagtggcttgggggtaggtgccatggggatgattttttaaaataaaattatttaaatcc

SEQ ID NO: 137419 - DNA, 5708 bp, Homo sapiens
  Payload ID: 6905
  Gene Symbol: GRIA1
  Gene Name: glutamate receptor, ionotropic, AMPA 1
  Uniprot ID: P42261
  ENST ID: ENST00000285900
  CDS Start-End: 344-3064
gtgtgagggggagagcgagagagagcaagggagggagagagaggcaggctgcgaggggagaggagagggagtgggggagccagcgctccagctagcatgaggacgggcttcttttcccgtgctcagttaatctggctgtcagttggtgttaacgctgcagtttaagtgttcggattccaagggaaacagacaaacctcacgaaaggaaggaagcaagcaagcaaggaaggaactgcaggaggaaaagaacaggcagaacagcgagaagaataaagggaaagggggggaaacaccaaatctatgattggacctgggcttctttttcgccaatgcaaaaaggaatatgcagcacatttttgccttcttctgcaccggtttcctaggcgcggtagtaggtgccaatttccccaacaatatccagatcgggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactgaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccagccccatcccaaacccttcagtgccaaaaacaacaacaaaatgaaacgcaaccaccaccaaccactgcgaccacaagaaggatgattcaacaggttttcctgaagaattgaaaaaccattttgctgtcccttttccttttttgatgttctttcacccttttctgtttgctaagtgaggatgaaaaaataacactgtactgcaataaggggagagtaaccctgtctaatgaaacctgtgtctctgagagtagagtcactggaacactaatgaggaaactgcactgttttattttaattcagttgttagtgtgtcttagtgtgtgcaattttttttcttactaatatccatggtttgcaggttctgttaggccctttccttctccttacttcttatccccaactccctacccacccctcttcagttttcagattggagattcaagatttgttccactttacaagcaagaggaaaaaaaagcaaccttcaaactaattctccatgggggctctccatgttaccctccactccttggcccaaacctctgatggagatagacattgttggagaagtgggctgccttccccaagtggggcactgcttaagcacttattcagtggagaacacaggtgaaaagcaactcaggatgagggtggtggagagggcaggggcagatgtgcagtcagagaaggactcctgaagttactgctgctcagaaaaacagttcctttaatgtggaagagccatttcataggtcataggtggtatggtatatttcttcagagtcaaccttggccctgagaagtatgtcctcctggtgtgctcaggctcaacggcagtctggtggctgaaggcacttggcctcctaaaccaagcagaattttgggaagagataacagccagggagatattgcccatgattctcactttttctttgcctggcatctaagcaggaacccattgtggagtagactctcttcttctatggagcctctgacatggggagcaatgctaagcaagctaagtgtaaaagaaaagtgacagaataattttggaagaggaagcctcatcaaaagctcacacaaaatagagcttcccatggtgtgccctatcctaggtttaagaaaacacgtatgaagtttatgctgatgcaaagaacttgggtttttatgttaatataaagtgttgttttagcatgtggccagatgatgctctgtcatctttagaaagtgagataaccaaggaaataattgaaggagtatagggagatggattaagttgataatgacatttagggcaacttaagacctttgatcccaggttctaactcaaagaggctgaccttcccccagctaagatagcatgaggacgttgtattccaatatacgtatgattggggctacaaagctgaactaaagcaagattggtgaagtggcagggtttatagagagaagcccaggctgagttcagcttttgttggaagtgagaatccctgacatatagctttcttggagatcccaactctcattcttggtgcaactggcttccagctctccagcagtcactctcctaggtgcatgattcagtgcgtgccatgtgtcattagcttttactgataaccatattctggcttgttcccttaccccctacttctatccaattttctctgctaggggttatcattagcaattgacatgctaaaggttttggagcccacctaggggtaggtgcagctttattggcttttctgtggattctctcagtggacccacaccatctctatgtctctccactctcctgccttcagccatagcaaagaatccttccaaaatcaaactcttcacttttttgactcaagtgttgttgttcagtctctcgcgtgtcaatgtggtcatggttcatgaaaccggaccctcaagatggatgattgcttttaactactgccagctgatgtctctcagcccctgccctcatacaagatttttctcagccttcagcctaccactgcagaatccgatgtgacccaccattagggagtctgcatcttggaagagttggaaataaccctttaacatcaacatgcttcaaagactttttgcctttggcctagtaagatgcctctccagctactgagcccacaagtaacatgagcggataaaaagagacttgtttgtgctagaaatgagggtctatgctatgagggggtccaagactctggcgaaatgtgctttttcatcaatggagaaatgaaaggaaaacacaagcaagaaaaaagttaacttgtattatgtatttttactacacttttcttaaaaatagagcattgggaaaactctgaaagagactgacatttttctcaacaggaatccatacttaacagttctggctttcattaaattttgctctttggtacctgggccttttatttaacatctatatttgttttaactctcttggcagatgtgtgaaaggattcttgcttgatcaaacactaagtatttttttggttcttgtttttctttcaaatagccaggtttttttcttttggtatttgcataaaatgaaaatatcaccgaatattaaatcactgtggatccatta

SEQ ID NO: 137420 - DNA, 3170 bp, Homo sapiens
  Payload ID: 6905
  Gene Symbol: GRIA1
  Gene Name: glutamate receptor, ionotropic, AMPA 1
  Uniprot ID: P42261
  ENST ID: ENST00000340592
  CDS Start-End: 74-2794
taaagggaaagggggggaaacaccaaatctatgattggacctgggcttctttttcgccaatgcaaaaaggaatatgcagcacatttttgccttcttctgcaccggtttcctaggcgcggtagtaggtgccaatttccccaacaatatccagatcgggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaggtcccgtaaacctagcggttttgaaactcagtgagcaaggcgtcttagacaagctgaaaagcaaatggtggtacgataaaggggaatgtggaagcaaggactccggaagtaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccagccccatcccaaacccttcagtgccaaaaacaacaacaaaatgaaacgcaaccaccaccaaccactgcgaccacaagaaggatgattcaacaggttttcctgaagaattgaaaaaccattttgctgtcccttttccttttttgatgttctttcacccttttctgtttgctaagtgaggatgaaaaaataacactgtactgcaataaggggagagtaaccctgtctaatgaaacctgtgtctctgagagtagagtcactggaacactaatgaggaaactgcactgttttattttaattcagttgttagtgtgtcttagtgtgtgcaattttt

SEQ ID NO: 137421 - DNA, 2825 bp, Homo sapiens
  Payload ID: 6905
  Gene Symbol: GRIA1
  Gene Name: glutamate receptor, ionotropic, AMPA 1
  Uniprot ID: P42261
  ENST ID: ENST00000448073
  CDS Start-End: 28-2778
gtgcaattgatattttgtcgggcatacatgtgctgcagtacccatctctttcagcctctccagctagctggcggcttggagtggccatggagtaacttgctttgtttcctgacacctgttaagctacatcctgaagtgtggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaggtcccgtaaacctagcggttttgaaactcagtgagcaaggcgtcttagacaagctgaaaagcaaatggtggtacgataaaggggaatgtggaagcaaggactccggaagtaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccagc

SEQ ID NO: 137422 - DNA, 3069 bp, Homo sapiens
  Payload ID: 6905
  Gene Symbol: GRIA1
  Gene Name: glutamate receptor, ionotropic, AMPA 1
  Uniprot ID: P42261
  ENST ID: ENST00000521843
  CDS Start-End: 162-2675
attgcttggtagatggtgcttgattccatttttaatggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactgaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccagccccatcccaaacccttcagtgccaaaaacaacaacaaaatgaaacgcaaccaccaccaaccactgcgaccacaagaaggatgattcaacaggttttcctgaagaattgaaaaaccattttgctgtcccttttccttttttgatgttctttcacccttttctgtttgctaagtgaggatgaaaaaataacactgtactgcaataaggggagagtaaccctgtctaatgaaacctgtgtctctgagagtagagtcactggaacactaatgaggaaactgcactgttttattttaattcagttgttagtgtgtcttagtgtgtgcaattttttttcttactaatatccat

SEQ ID NO: 137423 - DNA, 2761 bp, Homo sapiens
  Payload ID: 6905
  Gene Symbol: GRIA1
  Gene Name: glutamate receptor, ionotropic, AMPA 1
  Uniprot ID: P42261
  ENST ID: ENST00000518142
  CDS Start-End: 235-2715
tcttttcccgtgctcagttaatctggctgtcagttggtgttaacgctgcagtttaagtgttcggattccaagggaaacagacaaacctcacgaaaggaaggaagcaagcaagcaaggaaggaactgcaggaggaaaagaacaggcagaacagcgagaagaataaagggaaagggggggaaacaccaaatctatgattggacctgggcttctttttcgccaatgcaaaaaggaatatgcagcacatttttgccttcttctgcaccggtttcctaggcgcggtagtaggtgccaatttccccaacaatatccagatcgggggattatttccaaaccagcagtcacaggaacatgctgcttttagatttgctttgtcgcaactcacagagcccccgaagctgctcccccagattgatattgtgaacatcagcgacagctttgagatgacctatagatgcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactgaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccag

SEQ ID NO: 137424 - DNA, 5233 bp, Homo sapiens
  Payload ID: 6905
  Gene Symbol: GRIA1
  Gene Name: glutamate receptor, ionotropic, AMPA 1
  Uniprot ID: P42261
  ENST ID: ENST00000518783
  CDS Start-End: 28-2778
gtgcaattgatattttgtcgggcatacatgtgctgcagtacccatctctttcagcctctccagctagctggcggcttggagtggccatggagtaacttgctttgtttcctgacacctgttaagctacatcctgaagtgtggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactgaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccagccccatcccaaacccttcagtgccaaaaacaacaacaaaatgaaacgcaaccaccaccaaccactgcgaccacaagaaggatgattcaacaggttttcctgaagaattgaaaaaccattttgctgtcccttttccttttttgatgttctttcacccttttctgtttgctaagtgaggatgaaaaaataacactgtactgcaataaggggagagtaaccctgtctaatgaaacctgtgtctctgagagtagagtcactggaacactaatgaggaaactgcactgttttattttaattcagttgttagtgtgtcttagtgtgtgcaattttttttcttactaatatccatggtttgcaggttctgttaggccctttccttctccttacttcttatccccaactccctacccacccctcttcagttttcagattggagattcaagatttgttccactttacaagcaagaggaaaaaaaagcaaccttcaaactaattctccatgggggctctccatgttaccctccactccttggcccaaacctctgatggagatagacattgttggagaagtgggctgccttccccaagtggggcactgcttaagcacttattcagtggagaacacaggtgaaaagcaactcaggatgagggtggtggagagggcaggggcagatgtgcagtcagagaaggactcctgaagttactgctgctcagaaaaacagttcctttaatgtggaagagccatttcataggtcataggtggtatggtatatttcttcagagtcaaccttggccctgagaagtatgtcctcctggtgtgctcaggctcaacggcagtctggtggctgaaggcacttggcctcctaaaccaagcagaattttgggaagagataacagccagggagatattgcccatgattctcactttttctttgcctggcatctaagcaggaacccattgtggagtagactctcttcttctatggagcctctgacatggggagcaatgctaagcaagctaagtgtaaaagaaaagtgacagaataattttggaagaggaagcctcatcaaaagctcacacaaaatagagcttcccatggtgtgccctatcctaggtttaagaaaacacgtatgaagtttatgctgatgcaaagaacttgggtttttatgttaatataaagtgttgttttagcatgtggccagatgatgctctgtcatctttagaaagtgagataaccaaggaaataattgaaggagtatagggagatggattaagttgataatgacatttagggcaacttaagacctttgatcccaggttctaactcaaagaggctgaccttcccccagctaagatagcatgaggacgttgtattccaatatacgtatgattggggctacaaagctgaactaaagcaagattggtgaagtggcagggtttatagagagaagcccaggctgagttcagcttttgttggaagtgagaatccctgacatatagctttcttggagatcccaactctcattcttggtgcaactggcttccagctctccagcagtcactctcctaggtgcatgattcagtgcgtgccatgtgtcattagcttttactgataaccatattctggcttgttcccttaccccctacttctatccaattttctctgctaggggttatcattagcaattgacatgctaaaggttttggagcccacctaggggtaggtgcagctttattggcttttctgtggattctctcagtggacccacaccatctctatgtctctccactctcctgccttcagccatagcaaagaatccttccaaaatcaaactcttcacttttttgactcaagtgttgttgttcagtctctcgcgtgtcaatgtggtcatggttcatgaaaccggaccctcaagatggatgattgcttttaactactgccagctgatgtctctcagcccctgccctcatacaagatttttctcagccttcagcctaccactgcagaatccgatgtgacccaccattagggagtctgcatcttggaagagttggaaataaccctttaacatcaacatgcttcaaagactttttgcctttggcctagtaagatgcctctccagctactgagcccacaagtaacatgagcggataaaaagagacttgtttgtgctagaaatgagggtctatgctatgagggggtccaagactctggcgaaatgtgctttttcatcaatggagaaatgaaaggaaaacacaagcaagaaaaaagttaacttgtattatgtatttttactacacttttcttaaaaatagagcattgggaaaactctgaaagagactgacatttttctcaacaggaatccatacttaacagttctggctttcattaaattttgctctttggta

SEQ ID NO: 137425 - DNA, 3445 bp, Homo sapiens
  Payload ID: 6906
  Gene Symbol: GRIA2
  Gene Name: glutamate receptor, ionotropic, AMPA 2
  Uniprot ID: P42262
  ENST ID: ENST00000264426
  CDS Start-End: 280-2931
ccgagacactgggaccacagcggcagctccgctgaaaactgcattcagccagtcctccggacttctggagcggggacagggcgcagggcatcagcagccaccagcaggacctgggaaatagggattcttctgcctccacttcaggttttagcagcttggtgctaaattgctgtctcaaaatgcagaggatctaatttgcagaggaaaacagccaaagaaggaagaggaggaaaaggaaaaaaaaaggggtatattgtggatgctctacttttcttggaaatgcaaaagattatgcatatttctgtcctcctttctcctgttttatggggactgatttttggtgtctcttctaacagcatacagataggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaatgcggttaacctcgcagtactaaaactgaatgaacaaggcctgttggacaaattgaaaaacaaatggtggtacgacaaaggagagtgcggcagcgggggaggtgattccaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggggatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaagacttttctttcagccaagaattcttaaatatgtggagttcatcttgaattgtaaggaatgattaattaaaacacaacatctttttctactcgagttacagacaaagcgtggtggacatgcacagctaacatggaagtactataatttacctgaagtctttgtacagacaacaaacctgtttctgcagccactattgttagtctcttgattcataatgacttaagcacacttgacatcaactgcatcaagatgtgacatgt

SEQ ID NO: 137426 - DNA, 5621 bp, Homo sapiens
  Payload ID: 6906
  Gene Symbol: GRIA2
  Gene Name: glutamate receptor, ionotropic, AMPA 2
  Uniprot ID: P42262
  ENST ID: ENST00000296526
  CDS Start-End: 326-2977
gagagagggtgagtgtgtgtgagtgcatgggagggtgctgaatattccgagacactgggaccacagcggcagctccgctgaaaactgcattcagccagtcctccggacttctggagcggggacagggcgcagggcatcagcagccaccagcaggacctgggaaatagggattcttctgcctccacttcaggttttagcagcttggtgctaaattgctgtctcaaaatgcagaggatctaatttgcagaggaaaacagccaaagaaggaagaggaggaaaaggaaaaaaaaaggggtatattgtggatgctctacttttcttggaaatgcaaaagattatgcatatttctgtcctcctttctcctgttttatggggactgatttttggtgtctcttctaacagcatacagataggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaccccagtaaatcttgcagtattgaaactcagtgagcaaggcgtcttagacaagctgaaaaacaaatggtggtacgataaaggtgaatgtggagccaaggactctggaagtaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggggatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaagacttttctttcagccaagaattcttaaatatgtggagttcatcttgaattgtaaggaatgattaattaaaacacaacatctttttctactcgagttacagacaaagcgtggtggacatgcacagctaacatggaagtactataatttacctgaagtctttgtacagacaacaaacctgtttctgcagccactattgttagtctcttgattcataatgacttaagcacacttgacatcaactgcatcaagatgtgacatgttttataaaaaaaggaaaaaaaacatttaaaactaaaaaatatttttaggtattttcacaaacaaactggcttttaaataaatttgcttccatattggttgaataagacaaaaacaattaaactgagtgggaagtgaataaaaaaaggctttaggtatcgattccatatttttcaaagccaaatatgtaaatgctaaggaaagtaaacaaagaggagattccaatcttgtaatttaatattgttattaaaactttaatgtatcctattctttaacatttggtgttaatataaaattacttggcaatgcttgacatttgaaataaacatttttctattgttttattgcaagtggtccaattaattttgcttagctacagtttggtcataaatcaagtgagtttaaagacactaccaagttgttaggtgcccagagaaaatttctcccttttaaaaaggccaggtgatttttcaaatgtaatcttgcccccaaagtaatatctgaatatctttttgacatgtctaaatatatatatatataaagaaatatttgttaacacaaaagcatttgatctatgtagataaatgctaatagatttaaaaagctaatattaacaaataccagaatacgtgaagttccatttttaaagtgtttgagcttacagaagagaaacattcattttaaatgaagtaaaaaatgccttgaaagtaattctttagatagttgcccattgattaaattccaaaaactaaatatgtttttagctttaaaattataaaagctgtcataaactttatatattatgaattttaaaatatgtttgagtctcctgcaatatagtttcatcccattgacatcaattaaaaataaccctaatatattatttttatatttattcctcaggtggaatggctattttaatatgcccagtgtggataaaatgtcacatttctgtaacttttgactaaagagcctatatttatctagttaatgaatttaaaggatctatctttcccttcataaaatacctcttatttccattaaagccccccaagtttaattaatttaggattttgaatgattattgacatccaatagttatttttaatatttgtattcttgttatttctggaagaaagcctttgtgtagcacttggtattttgcaaagtgcttttaaaacattcttacttaccgtatttcatagaagggaaggaaaaatgtaaggtttaacagtaagcacttgcattgaacatggaggcatgtggtatcatgatattcttcactaaatttagctgtccctaatcacagatcctaaggtaatataatataattttagtgcatttctcctcatcaggaatgctggaggtgcattttaagttttaataataagtgctagaatgaccaaattgcagactaattgtttccatattgtacttaaaatgagtttttaaaagtgaaaaagaaatgactatatacaatcaatgctatttattgtacctctgggcctactcttctaaaaattgtagcttatcgatttttctctgtcaagcttgaactaatgtaaataattgaaataatgtaaagttatattttcatgtttttatagatacaacatgacaagaatacataatgtaagagtatttcaactatggataatgttgattggataatgcacatctcagttacaagcagtactcatagtttaatatccatgtaacggtgcatcaatatattgctatataaatatgtctgtgtgcatataagtgaaaagtggtcaaacaagagtgatgacagctgtctaaaggtttttttattcattttatataaaaactgttatggaaagaccaaaatgtttatgaactattcttatgtaaatttacaattgtcctttactgtacttttttgtttacagtatagtaccttattttctgctgtgttaagtgggtgtcaaactccaagaagacatacactttctataacttctattgaagatattggaatttccaatttttcatgtgtactatgtcagaaaatgctttcgattttatttttaaatctaacatcggatggcttttccggagtgttgtaaaaacttcaatcatacataaaacatgttcttacaaaaggcaaa

SEQ ID NO: 137427 - DNA, 2798 bp, Homo sapiens
  Payload ID: 6906
  Gene Symbol: GRIA2
  Gene Name: glutamate receptor, ionotropic, AMPA 2
  ENST ID: ENST00000323661
  CDS Start-End: 355-2547
attccagatttaaactacctagaatatacatgtttttcttaggatgaagcaaaaggaaaagactatgcctttgatacaatagaagaaaaggtcctctcatttcggatccccaaattttattaattctgccttagcgacattttccagtttgctcagattttcttggggtctgaatgcaaagcttgtgattacatggaaaggtgaaggtttctggccgcctacctcgccttcagactctcatctgggtcttgaccccttggctagcttttggatattccacccccgctgtccgagtccgtaggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagtggagtcacattcaagacactgttatttgtttgttgtggataaatgcggttaacctcgcagtactaaaactgaatgaacaaggcctgttggacaaattgaaaaacaaatggtggtacgacaaaggagagtgcggcagcgggggaggtgattccaagaaccccagtaaatcttgcagtattgaaactcagtgagcaaggcgtcttagacaagctgaaaaacaaatggtggtacgataaaggtgaatgtggagccaaggactctggaagtaaggaaaagaccagtgccctcagtct

SEQ ID NO: 137428 - DNA, 5260 bp, Homo sapiens
  Payload ID: 6906
  Gene Symbol: GRIA2
  Gene Name: glutamate receptor, ionotropic, AMPA 2
  Uniprot ID: P42262
  ENST ID: ENST00000393815
  CDS Start-End: 112-2622
gtgtgtgcgcgcgcgcgtgagtgagagaggagagagggagaagagagcgcgagagagggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaccccagtaaatcttgcagtattgaaactcagtgagcaaggcgtcttagacaagctgaaaaacaaatggtggtacgataaaggtgaatgtggagccaaggactctggaagtaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggggatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaagacttttctttcagccaagaattcttaaatatgtggagttcatcttgaattgtaaggaatgattaattaaaacacaacatctttttctactcgagttacagacaaagcgtggtggacatgcacagctaacatggaagtactataatttacctgaagtctttgtacagacaacaaacctgtttctgcagccactattgttagtctcttgattcataatgacttaagcacacttgacatcaactgcatcaagatgtgacatgttttataaaaaaaggaaaaaaaacatttaaaactaaaaaatatttttaggtattttcacaaacaaactggcttttaaataaatttgcttccatattggttgaataagacaaaaacaattaaactgagtgggaagtgaataaaaaaaggctttaggtatcgattccatatttttcaaagccaaatatgtaaatgctaaggaaagtaaacaaagaggagattccaatcttgtaatttaatattgttattaaaactttaatgtatcctattctttaacatttggtgttaatataaaattacttggcaatgcttgacatttgaaataaacatttttctattgttttattgcaagtggtccaattaattttgcttagctacagtttggtcataaatcaagtgagtttaaagacactaccaagttgttaggtgcccagagaaaatttctcccttttaaaaaggccaggtgatttttcaaatgtaatcttgcccccaaagtaatatctgaatatctttttgacatgtctaaatatatatatatataaagaaatatttgttaacacaaaagcatttgatctatgtagataaatgctaatagatttaaaaagctaatattaacaaataccagaatacgtgaagttccatttttaaagtgtttgagcttacagaagagaaacattcattttaaatgaagtaaaaaatgccttgaaagtaattctttagatagttgcccattgattaaattccaaaaactaaatatgtttttagctttaaaattataaaagctgtcataaactttatatattatgaattttaaaatatgtttgagtctcctgcaatatagtttcatcccattgacatcaattaaaaataaccctaatatattatttttatatttattcctcaggtggaatggctattttaatatgcccagtgtggataaaatgtcacatttctgtaacttttgactaaagagcctatatttatctagttaatgaatttaaaggatctatctttcccttcataaaatacctcttatttccattaaagccccccaagtttaattaatttaggattttgaatgattattgacatccaatagttatttttaatatttgtattcttgttatttctggaagaaagcctttgtgtagcacttggtattttgcaaagtgcttttaaaacattcttacttaccgtatttcatagaagggaaggaaaaatgtaaggtttaacagtaagcacttgcattgaacatggaggcatgtggtatcatgatattcttcactaaatttagctgtccctaatcacagatcctaaggtaatataatataattttagtgcatttctcctcatcaggaatgctggaggtgcattttaagttttaataataagtgctagaatgaccaaattgcagactaattgtttccatattgtacttaaaatgagtttttaaaagtgaaaaagaaatgactatatacaatcaatgctatttattgtacctctgggcctactcttctaaaaattgtagcttatcgatttttctctgtcaagcttgaactaatgtaaataattgaaataatgtaaagttatattttcatgtttttatagatacaacatgacaagaatacataatgtaagagtatttcaactatggataatgttgattggataatgcacatctcagttacaagcagtactcatagtttaatatccatgtaacggtgcatcaatatattgctatataaatatgtctgtgtgcatataagtgaaaagtggtcaaacaagagtgatgacagctgtctaaaggtttttttattcattttatataaaaactgttatggaaagaccaaaatgtttatgaactattcttatgtaaatttacaattgtcctttactgtacttttttgtttacagtatagtaccttattttctgctgtgttaagtgggtgtcaaactccaagaagacatacactttctataacttctattgaagatattggaatttccaatttttcatgtgtactatgtcagaaaatgctttcgattttatttttaaatctaacatcggatggcttttccggagtgttgtaaaaacttcaatcatacataaaacatgttcttacaaaa

SEQ ID NO: 137429 - DNA, 558 bp, Homo sapiens
  Payload ID: 6906
  Gene Symbol: GRIA2
  Gene Name: glutamate receptor, ionotropic, AMPA 2
  ENST ID: ENST00000505888
  CDS Start-End: 123-558
agcgcgcgcccctcctttccctcccggggcactgacactgttctcttgcttgctgtttgttctttgcaggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtacc

SEQ ID NO: 137430 - DNA, 763 bp, Homo sapiens
  Payload ID: 6906
  Gene Symbol: GRIA2
  Gene Name: glutamate receptor, ionotropic, AMPA 2
  ENST ID: ENST00000510854
  CDS Start-End: 1-643
attagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaccccagtaaatcttgcagtattgaaactcagtgagcaaggcgtcttagacaagctgaaaaacaaatggtggtacgataaaggtgaatgtggagccaaggactctggaagtaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttagggggtaggaacgaggctctaatacaaactttttagtgcacgtttagctttcttgttgcgtccttaagctcttttaaataaggaaggtggccaatggatcatcctgtatgtattgttgacg

SEQ ID NO: 137431 - DNA, 522 bp, Homo sapiens
  Payload ID: 6906
  Gene Symbol: GRIA2
  Gene Name: glutamate receptor, ionotropic, AMPA 2
  ENST ID: ENST00000512774
  CDS Start-End: 378-522
cccgtgcgctctgtaactaggcgagtcagcatcacagcccaatggaatatactctaaagatgggattttcatgcaaaatatttaaaagattccatcttgatctcttgtgcggcttaagcatttaaagatataacttggggttctccctggatcctggctacatcccatgaagcccaagtgcacaattttggaatatttcctccacggtgctttgcttgcttgtttgctttcggctgggtcaggttttagcagcttggtgctaaattgctgtctcaaaatgcagaggatctaatttgcagaggaaaacagccaaagaaggaagaggaggaaaaggaaaaaaaaaggggtatattgtggatgctctacttttcttggaaatgcaaaagattatgcatatttctgtcctcctttctcctgttttatggggactgatttttggtgtctcttctaacagcatacagataggggggctatttcctaggggcgccgatcaagaatacagtgcatttcgagtagggatgg

SEQ ID NO: 137432 - DNA, 544 bp, Homo sapiens
  Payload ID: 6906
  Gene Symbol: GRIA2
  Gene Name: glutamate receptor, ionotropic, AMPA 2
  ENST ID: ENST00000509417
  CDS Start-End: 171-544
agagaggagagagggagaagagagcgcgagagagggttttagcagcttggtgctaaattgctgtctcaaaatgcagaggatctaatttgcagaggaaaacagccaaagaaggaagaggaggaaaaggaaaaaaaaaggggtatattgtggatgctctacttttcttggaaatgcaaaagattatgcatatttctgtcctcctttctcctgttttatggggactgatttttggtgtctcttctaacagcatacagataggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgt

SEQ ID NO: 137433 - DNA, 429 bp, Homo sapiens
  Payload ID: 6906
  Gene Symbol: GRIA2
  Gene Name: glutamate receptor, ionotropic, AMPA 2
  ENST ID: ENST00000506284
  CDS Start-End: 259-429
ttcagccagtcctccggacttctggagcggggacagggcgcagggcatcagcagccaccagcaggacctgggaaatagggattcttctgcctccacttcaggttttagcagcttggtgctaaattgctgtctcaaaatgcagaggatctaatttgcagaggaaaacagccaaagaaggaagaggaggaaaaggaaaaaaaaaggggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgc

SEQ ID NO: 137434 - DNA, 556 bp, Homo sapiens
  Payload ID: 6906
  Gene Symbol: GRIA2
  Gene Name: glutamate receptor, ionotropic, AMPA 2
  ENST ID: ENST00000503437
  CDS Start-End: 243-556
tatttattgaatgcttttgacatacggaggaattaattccagaaagaccagaggaactaaaaatcttgaaagagaaccaccattttagtgtctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagg

SEQ ID NO: 137435 - DNA, 3041 bp, Homo sapiens
  Payload ID: 6906
  Gene Symbol: GRIA2
  Gene Name: glutamate receptor, ionotropic, AMPA 2
  Uniprot ID: P42262
  ENST ID: ENST00000507898
  CDS Start-End: 278-2788
aggtgaggaggatgacagggcttctgtattgctaaatgggttttcacaggagatggaagataaaaatcaaaattatttgtaacgtaagacagcagggcctggtgagaggacgcttcgccgccaacaattagcaattcggcttctacacagcagccggagatcagctttgctgcatttggtccaggttggagcatctccgcagcagctgcaacagccgcacgaaggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaccccagtaaatcttgcagtattgaaactcagtgagcaaggcgtcttagacaagctgaaaaacaaatggtggtacgataaaggtgaatgtggagccaaggactctggaagtaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggggatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaa

SEQ ID NO: 137436 - DNA, 2740 bp, Homo sapiens
  Payload ID: 6907
  Gene Symbol: GRIA3
  Gene Name: glutamate receptor, ionotropic, AMPA 3
  Uniprot ID: P42263
  ENST ID: ENST00000541091
  CDS Start-End: 54-2738
tgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaatgagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaagaaatgctgttaacctggcagtattaaaactgaatgagcaaggcctcttggacaaattgaaaaacaaatggtggtacgacaaaggagagtgcggcagcgggggcggtgactccaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctaggg

SEQ ID NO: 137437 - DNA, 4943 bp, Homo sapiens
  Payload ID: 6907
  Gene Symbol: GRIA3
  Gene Name: glutamate receptor, ionotropic, AMPA 3
  Uniprot ID: P42263
  ENST ID: ENST00000620443
  CDS Start-End: 54-2738
tgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaatgagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaagaacgcctgtaaaccttgcagtattgaaactcagtgaacaaggcatcttagacaagctgaaaaacaaatggtggtacgataagggggaatgtggagccaaggactccgggagtaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctagggatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcactaattacctcctatataacgacgtatgcttcctgtagttcagtagtttgctctcatcgataacgtgcattgggaagtttccagactgcaaaaactaggagctcgcattcatttcccaagtgtgacccttagatgcttagttgactcgctgcatatttgctcttgtcttcagaaaagaaaggaagaagtatcgttccaacgaaatgtttccagaaaagtgtactataaactttcattccaaaaatggtgtcataagcaaacaactcacttgtcaaatttcaaatggtattgaacaaaaaaagaaagctgttgtgtttttgttttgttttgttttcatgaaactgtgattttcaacttatgaatgctataatgtcccagcgcgggaagctcacgctgtgtgaacatgaagttgtataaaacaaaccaaccaacctacacacaaatgttttcataggcactgtataaagaaaaatgtatgtttattaactcaaatcagtttttcagagaggaaacgtcactgagatgaagaggcgggtaaattggtttgttattttttaaaaaaaacttgcatgtttaaaaaaaagttgattgcttcaaatttctgctactaacttcaagctatgggagtttggcagtagtcacttgaggattttttttccaattcttttctttttgttgttaaagctgtacttcagtgaacagaaaaattgccaagcaaactaatggctataaaagcgtaatttgcatgtgtgggcataaactacagagcctcattgccatgaggtattgtacaaagttttaatacattttgtaaataaaattgtaaagaaagaa

SEQ ID NO: 137438 - DNA, 936 bp, Homo sapiens
  Payload ID: 6907
  Gene Symbol: GRIA3
  Gene Name: glutamate receptor, ionotropic, AMPA 3
  ENST ID: ENST00000611689
  CDS Start-End: 238-672
cgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtcctgctgaaagggactacctgccttggccaggaagcatcagggaaaacaattggacagctctgccgtgctgcaaagatcatgggctgctgcacctaaaatgttcaccaggtggggcccgccaaaactgggcctattgtatctggggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaa

SEQ ID NO: 137439 - DNA, 784 bp, Homo sapiens
  Payload ID: 6907
  Gene Symbol: GRIA3
  Gene Name: glutamate receptor, ionotropic, AMPA 3
  ENST ID: ENST00000616590
  CDS Start-End: 86-520
cgctttggcaaacccagcttgcagccaatgaacccgccttccagattggtgtgaagacagaagtgagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtcctgctgaaagggactacctgccttggccaggaagcatcagggaaaacaattggacagctctgccgtgctgcaaagatcatgggctgctgcacctaaaatgttcaccaggtggggcccgccaaaactgggcctattgtatctggggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaa

SEQ ID NO: 137440 - DNA, 5173 bp, Homo sapiens
  Payload ID: 6907
  Gene Symbol: GRIA3
  Gene Name: glutamate receptor, ionotropic, AMPA 3
  Uniprot ID: P42263
  ENST ID: ENST00000622768
  CDS Start-End: 294-2978
agagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaatgagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaagaaatgctgttaacctggcagtattaaaactgaatgagcaaggcctcttggacaaattgaaaaacaaatggtggtacgacaaaggagagtgcggcagcgggggcggtgactccaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctagggatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcactaattacctcctatataacgacgtatgcttcctgtagttcagtagtttgctctcatcgataacgtgcattgggaagtttccagactgcaaaaactaggagctcgcattcatttcccaagtgtgacccttagatgcttagttgactcgctgcatatttgctcttgtcttcagaaaagaaaggaagaagtatcgttccaacgaaatgtttccagaaaagtgtactataaactttcattccaaaaatggtgtcataagcaaacaactcacttgtcaaatttcaaatggtattgaacaaaaaaagaaagctgttgtgtttttgttttgttttgttttcatgaaactgtgattttcaacttatgaatgctataatgtcccagcgcgggaagctcacgctgtgtgaacatgaagttgtataaaacaaaccaaccaacctacacacaaatgttttcataggcactgtataaagaaaaatgtatgtttattaactcaaatcagtttttcagagaggaaacgtcactgagatgaagaggcgggtaaattggtttgttattttttaaaaaaaacttgcatgtttaaaaaaaagttgattgcttcaaatttctgctactaacttcaagctatgggagtttggcagtagtcacttgaggattttttttccaattcttttctttttgttgttaaagctgtacttcagtgaacagaaaaattgccaagcaaactaatggctataaaagcgtaatttgcatgtgtgggcataaactacagagcctcattgccatgaggtattgtacaaagttttaatacattttgtaaataaaattgt

SEQ ID NO: 137441 - DNA, 2991 bp, Homo sapiens
  Payload ID: 6907
  Gene Symbol: GRIA3
  Gene Name: glutamate receptor, ionotropic, AMPA 3
  ENST ID: ENST00000620581
  CDS Start-End: 166-2640
agcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaatgagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaagaaatgctgttaacctggcagtattaaaactgaatgagcaaggcctcttggacaaattgaaaaacaaatggtggtacgacaaaggagagtgcggcagcgggggcggtgactccaagaacgcctgtaaaccttgcagtattgaaactcagtgaacaaggcatcttagacaagctgaaaaacaaatggtggtacgataagggggaatgtggagccaaggactccgggagtaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctagggatcccttcccactggaggcatgtg

SEQ ID NO: 137442 - DNA, 5508 bp, Homo sapiens
  Payload ID: 6908
  Gene Symbol: GRIA4
  Gene Name: glutamate receptor, ionotropic, AMPA 4
  Uniprot ID: P48058
  ENST ID: ENST00000282499
  CDS Start-End: 447-3155
agtggcagaagagggctaggctgagagggaagccaggactgtaggagagggaggcagcccgtcctcctcacgaacctgcaaggatgcggcaggggcctgggggcatggggaggtactaaccccccggagcccccgattggggcttgcagacctggcccgtgggcggattttctgcctagcgcagccgagaagcagaggtgccaggaaaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccgcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggatactcgatactccaagctattatggaaaaagcaggacaaaatggttggcatgtcagcgctatatgtgtggaaaattttaatgatgtcagctataggcaacttctagaagaacttgacagaagacaagagaagaagtttgtaatagactgtgagatagagagacttcaaaacatattagaacagattgtaagtgttggaaagcatgttaaaggctaccattatatcattgcaaacttgggattcaaggatatttctcttgagaggtttatacatggtggagccaatgttactggattccagttggtggattttaatacacctatggtaatcaaactaatggatcgctggaagaaactagatcagagagagtatccaggatctgagactcctccaaagtacacctctgctctgacttatgatggagtccttgtgatggctgaaactttccgaagtcttaggaggcagaaaattgatatctcaaggagaggaaatgctggggattgtctggcaaatcctgctgctccatggggccagggaattgacatggagaggacactcaaacaggttcgaattcaagggctgacagggaatgttcagtttgaccactatggacgtagagtcaattacacaatggatgtgtttgagctgaaaagcacaggacctagaaaggttggttactggaatgatatggataagttagtcttgattcaagatgtaccaactcttggcaatgacacagctgctattgagaacagaacagtggttgtaaccacaattatggaatccccatatgttatgtacaagaaaaatcatgaaatgtttgaaggaaatgacaagtatgaaggatactgtgtagatttggcatctgaaattgcaaaacatattggtatcaagtataaaattgccattgtccctgatggaaaatatggagcaagggatgcagacacaaaaatctggaatgggatggtaggagaacttgtttatgggaaagcagagattgctattgcccctctgacaatcactttggtacgagaggaggtcattgacttttctaagcccttcatgagtttgggcatatctatcatgatcaaaaagcctcagaaatccaaaccaggagtgttttccttcttggatcctctggcctatgagatttggatgtgcatagtctttgcctacattggtgtcagcgtggtcttattcctagttagtagatttagtccatatgagtggcacacagaagagccagaggacggaaaggaaggacccagcgaccagcctcccaatgagtttggcatctttaacagcctctggttttccctgggtgcttttatgcagcaaggatgtgacatttcacccagatccctctcaggtcgaattgttggaggtgtttggtggttctttacactcatcattatatcatcttatactgctaacctcgctgctttcctgacggttgagcgaatggtctctcccatagaaagtgcagaagacctggccaaacaaacagaaattgcctatggaacactggattcaggatcaacaaaagaattcttcagaagatcaaaaatagcagtgtatgaaaagatgtggacctacatgcgatcagcagagccatcagtattcactaggactacagctgagggagtagctcgtgtccgcaaatccaagggcaaatttgcctttctcctggagtccactatgaatgaatacattgagcagcgaaagccatgtgacacgatgaaagtgggaggaaatctggattccaaaggctatggagtagcaacgcccaagggttcctcattaagaactcctgtaaaccttgccgttttgaaactcagtgaggcaggcgtcttagacaagctgaaaaacaaatggtggtacgataaaggtgaatgtggacccaaggactctggaagcaaggacaagacgagtgccttgagcctgagcaatgtagcaggcgtcttctacattctggttggcggcttgggcttggcaatgctggtggctttgatagagttctgttacaagtccagggcagaagcgaagagaatgaagctgaccttttctgaagccataagaaacaaagccagattatccatcactgggagtgtgggagagaatggccgcgtcttgacgcctgactgcccaaaggctgtacacactggaactgcaatcagacaaagttcaggattggctgtcattgcatcggacctaccataaaaaccaaaaaaataattgagtgccttaattaaactgttggtgactggtggaaacgcagccctgagggacacgccacgcgcgggtctttgctaaaccaatcctttggctgagagcgggaagtccgtcctaacgcgctggccggacatcagcagcagcaacgtgtgcatgagctcagctcggaaacccaaactcagattttatatcaggaaaactcacaattgaggtttttttcggggagtgggtgggggagggatctgggatgggtgtattaacagcaacaaatttcattcgagtggactcaaaaactaatcagacttatgagttagcgcattaaactgtgaagttcttgctcagaaaggcctttgtcttcaccggaaaggataaaatagttgtagaagtccgtgaacatgctaacctgtgtctccagaacatccatatagtccatggaagaaaatccagctgagaaaacaaatcactaaactgtgataagaaaataatgaacaaacatgtaaaacctgtgggaaaaaaaaataaaggaagtatgtacacttactttggagaaaacaaatactgaaacatgcttgctttttaactgacgtaaattcagtagaggacaacacaattcttttttctaaccatcttagggaacaatacattgcaataattgatataaatgccatcactgtaataaactttagagacttttttttataaaagttgttggtcatcttcttgtttgctgtaaccttcactatgtcacatgagtcgattcaccgattgcatttgtctcacaaccaggaagaaaagcaaaaggaagaaaacgtttaggttcaatcatcagtctgcggtgtagactcgaaagagatgacaggtcactcatgttaatggtattatttataatctcattctgtgtacaacattgtggtttttgtacccaccaaaaagaataaaacagcagatgttcttacaatatctacagagcttaaaagttttttcttatcgttataaaagttatttgagaaattataagactataagagagattgtattagtggtgggccatagtggaaaatgtagctagccctcattattttttgcatactaagctacccctccttttcagatctttgactcattaacagattaaactgtcaaagatggagtctttgagttggggaatgaatcactgtcctaacaacaacataccttgtaattgtgtgttgaaattttacttgactgtattttgctgcataaaattatgtgtctcttgggcttcttcccttattcctattgttccctttaaatcatatgaaggcattcataatagcttggggtagataacaaatgaagaattagtctttgttttcaactggaaattgtaaagaaaattatactcatgtttatttataaaaatcaccttatgtatgaattaaactaacatggttcaaaagaaggtttggttcatttgaaataataaataagtactctaatacagataaaaatcatgtacttagggtattggcagaaagcacaagttaggatgatttcagaagtctggccttgaaggatgagttgagttttaacaggaggagaaggtgttaagagccatatgagtgagcagtggcccaaagccatgcacatcagtggctcatttaaggaatgaatgccattagatgggctactgagagtacagggatattatggaagataaagttggaaaagctgaaggattgattttcttccatcaactctcaagatcccattcgccattcaatctctgtgctgcagtaagagcaatcttaaacagtataaatcacacacacacacacacacacacacacacacacacacaagtccctcaggaaaaattccaagctcttgagaagatcacatgagccccttcatgacctggcgcttgcttatttcttccaggacttctctcacttctatccagctattcccgtcagcaaatgaacctccaaagcagcacatggagcactgcatagactatttcctcagtgcgtaactcctccctgtctcctctttacctgagtaacttgtactcatccttcaatactccaactgaattttacttaccctgaaaagatttccatggctatccaccacccccctgcctgtgagactgagttaggtgccctttttcatgtctttcccccatcacggcacttaccatactgcgttgtaattgcctgtgtactcgtctgtataactactagactgtaagctccttgagggcagggactgtgtctatcttgttcacagttgtatccccagcacccagcacagtgcctggcatattgtaggtgcttaataaatatttgttgaatgaatg

SEQ ID NO: 137443 - DNA, 2994 bp, Homo sapiens
  Payload ID: 6908
  Gene Symbol: GRIA4
  Gene Name: glutamate receptor, ionotropic, AMPA 4
  Uniprot ID: P48058
  ENST ID: ENST00000393125
  CDS Start-End: 491-1792
aaatctttgctgcagcgaggaccggagtcccccgcgcgcagcccagtggcagaagagggctaggctgagagggaagccaggactgtaggagagggaggcagcccgtcctcctcacgaacctgcaaggatgcggcaggggcctgggggcatggggaggtactaaccccccggagcccccgattggggcttgcagacctggcccgtgggcggattttctgcctagcgcagccgagaagcagaggtgccaggaaaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccgcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggatactcgatactccaagctattatggaaaaagcaggacaaaatggttggcatgtcagcgctatatgtgtggaaaattttaatgatgtcagctataggcaacttctagaagaacttgacagaagacaagagaagaagtttgtaatagactgtgagatagagagacttcaaaacatattagaacagattgtaagtgttggaaagcatgttaaaggctaccattatatcattgcaaacttgggattcaaggatatttctcttgagaggtttatacatggtggagccaatgttactggattccagttggtggattttaatacacctatggtaatcaaactaatggatcgctggaagaaactagatcagagagagtatccaggatctgagactcctccaaagtacacctctgctctgacttatgatggagtccttgtgatggctgaaactttccgaagtcttaggaggcagaaaattgatatctcaaggagaggaaatgctggggattgtctggcaaatcctgctgctccatggggccagggaattgacatggagaggacactcaaacaggttcgaattcaagggctgacagggaatgttcagtttgaccactatggacgtagagtcaattacacaatggatgtgtttgagctgaaaagcacaggacctagaaaggttggttactggaatgatatggataagttagtcttgattcaagatgtaccaactcttggcaatgacacagctgctattgagaacagaacagtggttgtaaccacaattatgcctctgatgaagaatcctattttaagaaattgatcaagaaagaaaagagttccgcgctgttcgaccattcctaactaaggctcaagtcttgttctccagtgtagtaaatttaagcttatttttcatgtgggattcttcttggatgaccaactctggactaccagaaaaaaaaaattttaagttctgtgacttttctgagatactagaacaaaagaagaattaatcttcatctttctcaagaaatagatgttgacaaagaatcacttagcgattctgacatatcaattcccctatcttgaaatgaggtcactgtatgtaaatgatggaattatatcactccatttccaagggtagattttctataagtaaatatctcggaatttgtgtgcttgttttctgaatatatacagttgttttctttaaagatctcttggaattttgcctgttctgtgtgaaataaagtgttttaatgtgcattataggtatgatatagagaatctcctttccatccttgttactaaagggactggacaaataaatcttaaaaccaaaatactgaattaattttgcaagcatggctagtttttaggaagcatgctatcaaaaaaaaaaagactaaaaatgactgaaaaaatccaactgttttatatatatataaatatatatatatttatatatatatataaaggatattctgtaaagttatatgttgtttgacagtaaagccatcaatatttttgctatcaaaatagtataatactagtatctttttgtatgaaaatgtaatctttatataaataatacctctgatatttgcaactgcataatcgttcagtaattcaaaaagacatactagaatcctttttctgaaagtgttccttcaatttgcttttgttgaaaacggtagtccaggacctatgatatccctccacttcattcattatgaaagaaatcccttgtagataaacaagatattggcatctgcatgtaattatccccagattcagctgaaaactcccaacacagatggaattggctagacattttaatatatgtgatacctatatctagatatagaaggctgagagtgagcactggatataattcattttgattgaaattgatatggtgttattgttcttccagttgtctgtcctttgtgtatgttcttatttatatgttgatacactgtaacactatatgctattgctaaataaaattgattgagaaattca

SEQ ID NO: 137444 - DNA, 5621 bp, Homo sapiens
  Payload ID: 6908
  Gene Symbol: GRIA4
  Gene Name: glutamate receptor, ionotropic, AMPA 4
  ENST ID: ENST00000393127
  CDS Start-End: 447-3101
agtggcagaagagggctaggctgagagggaagccaggactgtaggagagggaggcagcccgtcctcctcacgaacctgcaaggatgcggcaggggcctgggggcatggggaggtactaaccccccggagcccccgattggggcttgcagacctggcccgtgggcggattttctgcctagcgcagccgagaagcagaggtgccaggaaaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccgcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggatactcgatactccaagctattatggaaaaagcaggacaaaatggttggcatgtcagcgctatatgtgtggaaaattttaatgatgtcagctataggcaacttctagaagaacttgacagaagacaagagaagaagtttgtaatagactgtgagatagagagacttcaaaacatattagaacagattgtaagtgttggaaagcatgttaaaggctaccattatatcattgcaaacttgggattcaaggatatttctcttgagaggtttatacatggtggagccaatgttactggattccagttggtggattttaatacacctatggtaatcaaactaatggatcgctggaagaaactagatcagagagagtatccaggatctgagactcctccaaagtacacctctgctctgacttatgatggagtccttgtgatggctgaaactttccgaagtcttaggaggcagaaaattgatatctcaaggagaggaaatgctggggattgtctggcaaatcctgctgctccatggggccagggaattgacatggagaggacactcaaacaggttcgaattcaagggctgacagggaatgttcagtttgaccactatggacgtagagtcaattacacaatggatgtgtttgagctgaaaagcacaggacctagaaaggttggttactggaatgatatggataagttagtcttgattcaagatgtaccaactcttggcaatgacacagctgctattgagaacagaacagtggttgtaaccacaattatggaatccccatatgttatgtacaagaaaaatcatgaaatgtttgaaggaaatgacaagtatgaaggatactgtgtagatttggcatctgaaattgcaaaacatattggtatcaagtataaaattgccattgtccctgatggaaaatatggagcaagggatgcagacacaaaaatctggaatgggatggtaggagaacttgtttatgggaaagcagagattgctattgcccctctgacaatcactttggtacgagaggaggtcattgacttttctaagcccttcatgagtttgggcatatctatcatgatcaaaaagcctcagaaatccaaaccaggagtgttttccttcttggatcctctggcctatgagatttggatgtgcatagtctttgcctacattggtgtcagcgtggtcttattcctagttagtagatttagtccatatgagtggcacacagaagagccagaggacggaaaggaaggacccagcgaccagcctcccaatgagtttggcatctttaacagcctctggttttccctgggtgcttttatgcagcaaggatgtgacatttcacccagatccctctcaggtcgaattgttggaggtgtttggtggttctttacactcatcattatatcatcttatactgctaacctcgctgctttcctgacggttgagcgaatggtctctcccatagaaagtgcagaagacctggccaaacaaacagaaattgcctatggaacactggattcaggatcaacaaaagaattcttcagaagatcaaaaatagcagtgtatgaaaagatgtggacctacatgcgatcagcagagccatcagtattcactaggactacagctgagggagtagctcgtgtccgcaaatccaagggcaaatttgcctttctcctggagtccactatgaatgaatacattgagcagcgaaagccatgtgacacgatgaaagtgggaggaaatctggattccaaaggctatggagtagcaacgcccaagggttcctcattaagaaatgctgttaacctcgcagttttaaaactgaatgaacaaggcctcttggacaaattgaaaaacaaatggtggtacgacaaaggagaatgtggcagcgggggaggtgactccaaggacaagacgagtgccttgagcctgagcaatgtagcaggcgtcttctacattctggttggcggcttgggcttggcaatgctggtggctttgatagagttctgttacaagtccagggcagaagcgaagagaatgaaggtggcaaagagtgcacagacttttaacccaacttcctcgcagaatacccagaatttagcaacctatagagaaggttacaacgtatatggaaccgaaagtattaaaatttagggctgaccttttctgaagccataagaaacaaagccagattatccatcactgggagtgtgggagagaatggccgcgtcttgacgcctgactgcccaaaggctgtacacactggaactgcaatcagacaaagttcaggattggctgtcattgcatcggacctaccataaaaaccaaaaaaataattgagtgccttaattaaactgttggtgactggtggaaacgcagccctgagggacacgccacgcgcgggtctttgctaaaccaatcctttggctgagagcgggaagtccgtcctaacgcgctggccggacatcagcagcagcaacgtgtgcatgagctcagctcggaaacccaaactcagattttatatcaggaaaactcacaattgaggtttttttcggggagtgggtgggggagggatctgggatgggtgtattaacagcaacaaatttcattcgagtggactcaaaaactaatcagacttatgagttagcgcattaaactgtgaagttcttgctcagaaaggcctttgtcttcaccggaaaggataaaatagttgtagaagtccgtgaacatgctaacctgtgtctccagaacatccatatagtccatggaagaaaatccagctgagaaaacaaatcactaaactgtgataagaaaataatgaacaaacatgtaaaacctgtgggaaaaaaaaataaaggaagtatgtacacttactttggagaaaacaaatactgaaacatgcttgctttttaactgacgtaaattcagtagaggacaacacaattcttttttctaaccatcttagggaacaatacattgcaataattgatataaatgccatcactgtaataaactttagagacttttttttataaaagttgttggtcatcttcttgtttgctgtaaccttcactatgtcacatgagtcgattcaccgattgcatttgtctcacaaccaggaagaaaagcaaaaggaagaaaacgtttaggttcaatcatcagtctgcggtgtagactcgaaagagatgacaggtcactcatgttaatggtattatttataatctcattctgtgtacaacattgtggtttttgtacccaccaaaaagaataaaacagcagatgttcttacaatatctacagagcttaaaagttttttcttatcgttataaaagttatttgagaaattataagactataagagagattgtattagtggtgggccatagtggaaaatgtagctagccctcattattttttgcatactaagctacccctccttttcagatctttgactcattaacagattaaactgtcaaagatggagtctttgagttggggaatgaatcactgtcctaacaacaacataccttgtaattgtgtgttgaaattttacttgactgtattttgctgcataaaattatgtgtctcttgggcttcttcccttattcctattgttccctttaaatcatatgaaggcattcataatagcttggggtagataacaaatgaagaattagtctttgttttcaactggaaattgtaaagaaaattatactcatgtttatttataaaaatcaccttatgtatgaattaaactaacatggttcaaaagaaggtttggttcatttgaaataataaataagtactctaatacagataaaaatcatgtacttagggtattggcagaaagcacaagttaggatgatttcagaagtctggccttgaaggatgagttgagttttaacaggaggagaaggtgttaagagccatatgagtgagcagtggcccaaagccatgcacatcagtggctcatttaaggaatgaatgccattagatgggctactgagagtacagggatattatggaagataaagttggaaaagctgaaggattgattttcttccatcaactctcaagatcccattcgccattcaatctctgtgctgcagtaagagcaatcttaaacagtataaatcacacacacacacacacacacacacacacacacacacaagtccctcaggaaaaattccaagctcttgagaagatcacatgagccccttcatgacctggcgcttgcttatttcttccaggacttctctcacttctatccagctattcccgtcagcaaatgaacctccaaagcagcacatggagcactgcatagactatttcctcagtgcgtaactcctccctgtctcctctttacctgagtaacttgtactcatccttcaatactccaactgaattttacttaccctgaaaagatttccatggctatccaccacccccctgcctgtgagactgagttaggtgccctttttcatgtctttcccccatcacggcacttaccatactgcgttgtaattgcctgtgtactcgtctgtataactactagactgtaagctccttgagggcagggactgtgtctatcttgttcacagttgtatccccagcacccagcacagtgcctggcatattgtaggtgcttaataaatatttgttgaatgaatg

SEQ ID NO: 137445 - DNA, 2778 bp, Homo sapiens
  Payload ID: 6908
  Gene Symbol: GRIA4
  Gene Name: glutamate receptor, ionotropic, AMPA 4
  Uniprot ID: P48058
  ENST ID: ENST00000428631
  CDS Start-End: 275-1576
atttgcagccggacagaaaacctctcccagggctatggagactgcgggaaaaatctggcggctcgcgatggattgctaaggagaactagtcataatcttaaaccaccgaaacctctttccttttttttctttcttttctttcttttctttttttttttttttttttggttgattttaattttagcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggatactcgatactccaagctattatggaaaaagcaggacaaaatggttggcatgtcagcgctatatgtgtggaaaattttaatgatgtcagctataggcaacttctagaagaacttgacagaagacaagagaagaagtttgtaatagactgtgagatagagagacttcaaaacatattagaacagattgtaagtgttggaaagcatgttaaaggctaccattatatcattgcaaacttgggattcaaggatatttctcttgagaggtttatacatggtggagccaatgttactggattccagttggtggattttaatacacctatggtaatcaaactaatggatcgctggaagaaactagatcagagagagtatccaggatctgagactcctccaaagtacacctctgctctgacttatgatggagtccttgtgatggctgaaactttccgaagtcttaggaggcagaaaattgatatctcaaggagaggaaatgctggggattgtctggcaaatcctgctgctccatggggccagggaattgacatggagaggacactcaaacaggttcgaattcaagggctgacagggaatgttcagtttgaccactatggacgtagagtcaattacacaatggatgtgtttgagctgaaaagcacaggacctagaaaggttggttactggaatgatatggataagttagtcttgattcaagatgtaccaactcttggcaatgacacagctgctattgagaacagaacagtggttgtaaccacaattatgcctctgatgaagaatcctattttaagaaattgatcaagaaagaaaagagttccgcgctgttcgaccattcctaactaaggctcaagtcttgttctccagtgtagtaaatttaagcttatttttcatgtgggattcttcttggatgaccaactctggactaccagaaaaaaaaaattttaagttctgtgacttttctgagatactagaacaaaagaagaattaatcttcatctttctcaagaaatagatgttgacaaagaatcacttagcgattctgacatatcaattcccctatcttgaaatgaggtcactgtatgtaaatgatggaattatatcactccatttccaagggtagattttctataagtaaatatctcggaatttgtgtgcttgttttctgaatatatacagttgttttctttaaagatctcttggaattttgcctgttctgtgtgaaataaagtgttttaatgtgcattataggtatgatatagagaatctcctttccatccttgttactaaagggactggacaaataaatcttaaaaccaaaatactgaattaattttgcaagcatggctagtttttaggaagcatgctatcaaaaaaaaaaagactaaaaatgactgaaaaaatccaactgttttatatatatataaatatatatatatttatatatatatataaaggatattctgtaaagttatatgttgtttgacagtaaagccatcaatatttttgctatcaaaatagtataatactagtatctttttgtatgaaaatgtaatctttatataaataatacctctgatatttgcaactgcataatcgttcagtaattcaaaaagacatactagaatcctttttctgaaagtgttccttcaatttgcttttgttgaaaacggtagtccaggacctatgatatccctccacttcattcattatgaaagaaatcccttgtagataaacaagatattggcatctgcatgtaattatccccagattcagctgaaaactcccaacacagatggaattggctagacattttaatatatgtgatacctatatctagatatagaaggctgagagtgagcactggatataattcattttgattgaaattgatatggtgttattgttcttccagttgtctgtcctttgtgtatgttcttatttatatgttgatacactgtaacactatatgctattgctaaataaaattgattgagaaattca

SEQ ID NO: 137446 - DNA, 2822 bp, Homo sapiens
  Payload ID: 6908
  Gene Symbol: GRIA4
  Gene Name: glutamate receptor, ionotropic, AMPA 4
  ENST ID: ENST00000525187
  CDS Start-End: 1-2655
atgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggatactcgatactccaagctattatggaaaaagcaggacaaaatggttggcatgtcagcgctatatgtgtggaaaattttaatgatgtcagctataggcaacttctagaagaacttgacagaagacaagagaagaagtttgtaatagactgtgagatagagagacttcaaaacatattagaacagattgtaagtgttggaaagcatgttaaaggctaccattatatcattgcaaacttgggattcaaggatatttctcttgagaggtttatacatggtggagccaatgttactggattccagttggtggattttaatacacctatggtaatcaaactaatggatcgctggaagaaactagatcagagagagtatccaggatctgagactcctccaaagtacacctctgctctgacttatgatggagtccttgtgatggctgaaactttccgaagtcttaggaggcagaaaattgatatctcaaggagaggaaatgctggggattgtctggcaaatcctgctgctccatggggccagggaattgacatggagaggacactcaaacaggttcgaattcaagggctgacagggaatgttcagtttgaccactatggacgtagagtcaattacacaatggatgtgtttgagctgaaaagcacaggacctagaaaggttggttactggaatgatatggataagttagtcttgattcaagatgtaccaactcttggcaatgacacagctgctattgagaacagaacagtggttgtaaccacaattatggaatccccatatgttatgtacaagaaaaatcatgaaatgtttgaaggaaatgacaagtatgaaggatactgtgtagatttggcatctgaaattgcaaaacatattggtatcaagtataaaattgccattgtccctgatggaaaatatggagcaagggatgcagacacaaaaatctggaatgggatggtaggagaacttgtttatgggaaagcagagattgctattgcccctctgacaatcactttggtacgagaggaggtcattgacttttctaagcccttcatgagtttgggcatatctatcatgatcaaaaagcctcagaaatccaaaccaggagtgttttccttcttggatcctctggcctatgagatttggatgtgcatagtctttgcctacattggtgtcagcgtggtcttattcctagttagtagatttagtccatatgagtggcacacagaagagccagaggacggaaaggaaggacccagcgaccagcctcccaatgagtttggcatctttaacagcctctggttttccctgggtgcttttatgcagcaaggatgtgacatttcacccagatccctctcaggtcgaattgttggaggtgtttggtggttctttacactcatcattatatcatcttatactgctaacctcgctgctttcctgacggttgagcgaatggtctctcccatagaaagtgcagaagacctggccaaacaaacagaaattgcctatggaacactggattcaggatcaacaaaagaattcttcagaagatcaaaaatagcagtgtatgaaaagatgtggacctacatgcgatcagcagagccatcagtattcactaggactacagctgagggagtagctcgtgtccgcaaatccaagggcaaatttgcctttctcctggagtccactatgaatgaatacattgagcagcgaaagccatgtgacacgatgaaagtgggaggaaatctggattccaaaggctatggagtagcaacgcccaagggttcctcattaagaaatgctgttaacctcgcagttttaaaactgaatgaacaaggcctcttggacaaattgaaaaacaaatggtggtacgacaaaggagaatgtggcagcgggggaggtgactccaaggacaagacgagtgccttgagcctgagcaatgtagcaggcgtcttctacattctggttggcggcttgggcttggcaatgctggtggctttgatagagttctgttacaagtccagggcagaagcgaagagaatgaaggtggcaaagagtgcacagacttttaacccaacttcctcgcagaatacccagaatttagcaacctatagagaaggttacaacgtatatggaaccgaaagtattaaaatttagggctgaccttttctgaagccataagaaacaaagccagattatccatcactgggagtgtgggagagaatggccgcgtcttgacgcctgactgcccaaaggctgtacacactggaactgcaatcagacaaagttcaggattggctgtcattgcatcggacctaccataa

SEQ ID NO: 137447 - DNA, 2647 bp, Homo sapiens
  Payload ID: 6908
  Gene Symbol: GRIA4
  Gene Name: glutamate receptor, ionotropic, AMPA 4
  ENST ID: ENST00000527669
  CDS Start-End: 399-653
gggaggcagcccgtcctcctcacgaacctgcaaggatgcggcaggggcctgggggcatggggaggtactaaccccccggagcccccgattggggcttgcagacctggcccgtgggcggattttctgcctagcgcagccgagaagcagaggtgccaggaaaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccgcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgcctgtaagtaaaacataagctatgaaaaattagaagagaactgaaaccaagcaatggagtcctcttcctctttgttatttaatttttttagaaagaatttcaagattcccacagttgcctggtttcaggacaaatcagagttaaaaacaagacttcgtttcagggatatttagttgttttttttttcttttccttaatttatttttcttttctttcttctcctccctctctttgcttcttcctgactttctcttttattcattatctgtctagatcattcaagttaaattttcctttaacattttagtgttattcctatcatccgaatgtcaatttagtgaaaattgtactcaagctagttttttattcttttcctttggtttttcttatttgcttttcacttgagtaagcataggtcttgcttttaaagaagaaacatgaagactatggaaggcttgctaatagtgagaaaaagaggggagtggtggtgtggaggatatatatttgagtcggttggttgacgctgcagatgatctggtgatgtcacttgaggctgccctgcccttatattctggggtgtaaatgtctcttactatcacataatgcatatatcctgtggatataactccatgaatccttacctcgatgccaaatcacattaggctcccatccacctgaattcaccaaccaacccagctttatctattattccacacaatgaaactaaacgggtgacctcacctaatgccgtaagaaagcagttgtacaattcctcccactctcaccaggacactgtataacttaatgtaaaaaaaaaatacaatcaactgtgcatgttagtttaaaacacattgaaacatgatcagtcaatagcagttgtattgctttttccttctggaaggaagtgcatgtttcaaatacctcctcacatttatatgctaatttaccactgttttaaattcataaattcagataatgactatagattatttaagaagtaggaatagtttctacatacaattttgcatgttttcacagttaataaaatgttcaagctgaattgtaaagcctttttgtcatatcaagctgggaacatttttatttaaaattctttcagtacaagaaagtgtgctgaacaaagaaacaagtgaaattgaaaacagagtttttaaatttgtctggaggacatctgtttcatcaacttaaattatttaatttgtatgtgttggctgttaattcatatagcagataacatgataaaattttcttaatttttggtgtctctttaaccgttaattctttttagaacttagtttcatgaggagcttgaagcatatgtcacttttgcaaagtgaataattatattatttttcaggaaggctataggttctatgagttactacttaatttttaaaaatctcttgacatatttggtgataaaatcaatattgcattaaagcaaaagggtgttatttttattcagaagtgcacataaattagaacaaggtttgtgggtagtcctttttgtaaaatttctcagttaatagttttatgttccaagttttaaaagggatgtcagcattctaagtagttctaaggaaagcattctttttaatacgtaaatattatttgtttatttaaatatttttctcatgtctctcctaagattctgtcaatcttactacttttaaaaataatctatgatccaaatacatgtgaaggtactttatcaatagtaattattttaacatattaattattattattaaattttgaaagatttccttacaagtggcagatatatgttttattttgtttcatttttacaaagtaagatcttaaatattctaaagtttgtattgtgacttccagtaatgtaaactatatgaggctaatcctcttttcctcctttttgtttgttaacctcatttgggataactgtaactagtattattttatttatgtaataaaaatatatgtgaaataaagtgttactggtaaagta

SEQ ID NO: 137448 - DNA, 766 bp, Homo sapiens
  Payload ID: 6908
  Gene Symbol: GRIA4
  Gene Name: glutamate receptor, ionotropic, AMPA 4
  ENST ID: ENST00000531011
  CDS Start-End: 92-766
gcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggacttgtaatcagtaccacaccattggcaagtaattgtatgccaagttctgttgttcactcttggctttatgtgctctacaacaagagcataaactccataactgcttgccttttagggcctagcacagagctcaatgtatttaattacttgattgctgattcaaatttaaacaatggaaattacata

SEQ ID NO: 137449 - DNA, 470 bp, Homo sapiens
  Payload ID: 6908
  Gene Symbol: GRIA4
  Gene Name: glutamate receptor, ionotropic, AMPA 4
  ENST ID: ENST00000525921
  CDS Start-End: 224-470
agaggtgccaggaaaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccgcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgcct

SEQ ID NO: 137450 - DNA, 513 bp, Homo sapiens
  Payload ID: 6908
  Gene Symbol: GRIA4
  Gene Name: glutamate receptor, ionotropic, AMPA 4
  ENST ID: ENST00000525942
  CDS Start-End: 1-313
agtagctcgtgtccgcaaatccaagggcaaatttgcctttctcctggagtccactatgaatgaatacattgagcagcgaaagccatgtgacacgatgaaagtgggaggaaatctggattccaaaggctatggagtagcaacgcccaagggttcctcattaagaaatgctgttaacctcgcagttttaaaactgaatgaacaaggcctcttggacaaattgaaaaacaaatggtggtacgacaaaggagaatgtggcagcgggggaggtgactccaagaactcctgtaaaccttgccgttttgaaactcagtgaggcaggcgtcttagacaagctgaaaaacaaatggtggtacgataaaggtgaatgtggacccaaggactctggaagcaaggacaagacgagtgccttgagcctgagcaatgtagcaggcgtcttctacattctggttggcggcttgggcttggcaatgctggtggctttgatagagttctgttacaagtccagggcagaag

SEQ ID NO: 137451 - DNA, 5059 bp, Homo sapiens
  Payload ID: 6908
  Gene Symbol: GRIA4
  Gene Name: glutamate receptor, ionotropic, AMPA 4
  Uniprot ID: P48058
  ENST ID: ENST00000530497
  CDS Start-End: 1-2709
atgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggatactcgatactccaagctattatggaaaaagcaggacaaaatggttggcatgtcagcgctatatgtgtggaaaattttaatgatgtcagctataggcaacttctagaagaacttgacagaagacaagagaagaagtttgtaatagactgtgagatagagagacttcaaaacatattagaacagattgtaagtgttggaaagcatgttaaaggctaccattatatcattgcaaacttgggattcaaggatatttctcttgagaggtttatacatggtggagccaatgttactggattccagttggtggattttaatacacctatggtaatcaaactaatggatcgctggaagaaactagatcagagagagtatccaggatctgagactcctccaaagtacacctctgctctgacttatgatggagtccttgtgatggctgaaactttccgaagtcttaggaggcagaaaattgatatctcaaggagaggaaatgctggggattgtctggcaaatcctgctgctccatggggccagggaattgacatggagaggacactcaaacaggttcgaattcaagggctgacagggaatgttcagtttgaccactatggacgtagagtcaattacacaatggatgtgtttgagctgaaaagcacaggacctagaaaggttggttactggaatgatatggataagttagtcttgattcaagatgtaccaactcttggcaatgacacagctgctattgagaacagaacagtggttgtaaccacaattatggaatccccatatgttatgtacaagaaaaatcatgaaatgtttgaaggaaatgacaagtatgaaggatactgtgtagatttggcatctgaaattgcaaaacatattggtatcaagtataaaattgccattgtccctgatggaaaatatggagcaagggatgcagacacaaaaatctggaatgggatggtaggagaacttgtttatgggaaagcagagattgctattgcccctctgacaatcactttggtacgagaggaggtcattgacttttctaagcccttcatgagtttgggcatatctatcatgatcaaaaagcctcagaaatccaaaccaggagtgttttccttcttggatcctctggcctatgagatttggatgtgcatagtctttgcctacattggtgtcagcgtggtcttattcctagttagtagatttagtccatatgagtggcacacagaagagccagaggacggaaaggaaggacccagcgaccagcctcccaatgagtttggcatctttaacagcctctggttttccctgggtgcttttatgcagcaaggatgtgacatttcacccagatccctctcaggtcgaattgttggaggtgtttggtggttctttacactcatcattatatcatcttatactgctaacctcgctgctttcctgacggttgagcgaatggtctctcccatagaaagtgcagaagacctggccaaacaaacagaaattgcctatggaacactggattcaggatcaacaaaagaattcttcagaagatcaaaaatagcagtgtatgaaaagatgtggacctacatgcgatcagcagagccatcagtattcactaggactacagctgagggagtagctcgtgtccgcaaatccaagggcaaatttgcctttctcctggagtccactatgaatgaatacattgagcagcgaaagccatgtgacacgatgaaagtgggaggaaatctggattccaaaggctatggagtagcaacgcccaagggttcctcattaagaactcctgtaaaccttgccgttttgaaactcagtgaggcaggcgtcttagacaagctgaaaaacaaatggtggtacgataaaggtgaatgtggacccaaggactctggaagcaaggacaagacgagtgccttgagcctgagcaatgtagcaggcgtcttctacattctggttggcggcttgggcttggcaatgctggtggctttgatagagttctgttacaagtccagggcagaagcgaagagaatgaagctgaccttttctgaagccataagaaacaaagccagattatccatcactgggagtgtgggagagaatggccgcgtcttgacgcctgactgcccaaaggctgtacacactggaactgcaatcagacaaagttcaggattggctgtcattgcatcggacctaccataaaaaccaaaaaaataattgagtgccttaattaaactgttggtgactggtggaaacgcagccctgagggacacgccacgcgcgggtctttgctaaaccaatcctttggctgagagcgggaagtccgtcctaacgcgctggccggacatcagcagcagcaacgtgtgcatgagctcagctcggaaacccaaactcagattttatatcaggaaaactcacaattgaggtttttttcggggagtgggtgggggagggatctgggatgggtgtattaacagcaacaaatttcattcgagtggactcaaaaactaatcagacttatgagttagcgcattaaactgtgaagttcttgctcagaaaggcctttgtcttcaccggaaaggataaaatagttgtagaagtccgtgaacatgctaacctgtgtctccagaacatccatatagtccatggaagaaaatccagctgagaaaacaaatcactaaactgtgataagaaaataatgaacaaacatgtaaaacctgtgggaaaaaaaaataaaggaagtatgtacacttactttggagaaaacaaatactgaaacatgcttgctttttaactgacgtaaattcagtagaggacaacacaattcttttttctaaccatcttagggaacaatacattgcaataattgatataaatgccatcactgtaataaactttagagacttttttttataaaagttgttggtcatcttcttgtttgctgtaaccttcactatgtcacatgagtcgattcaccgattgcatttgtctcacaaccaggaagaaaagcaaaaggaagaaaacgtttaggttcaatcatcagtctgcggtgtagactcgaaagagatgacaggtcactcatgttaatggtattatttataatctcattctgtgtacaacattgtggtttttgtacccaccaaaaagaataaaacagcagatgttcttacaatatctacagagcttaaaagttttttcttatcgttataaaagttatttgagaaattataagactataagagagattgtattagtggtgggccatagtggaaaatgtagctagccctcattattttttgcatactaagctacccctccttttcagatctttgactcattaacagattaaactgtcaaagatggagtctttgagttggggaatgaatcactgtcctaacaacaacataccttgtaattgtgtgttgaaattttacttgactgtattttgctgcataaaattatgtgtctcttgggcttcttcccttattcctattgttccctttaaatcatatgaaggcattcataatagcttggggtagataacaaatgaagaattagtctttgttttcaactggaaattgtaaagaaaattatactcatgtttatttataaaaatcaccttatgtatgaattaaactaacatggttcaaaagaaggtttggttcatttgaaataataaataagtactctaatacagataaaaatcatgtacttagggtattggcagaaagcacaagttaggatgatttcagaagtctggccttgaaggatgagttgagttttaacaggaggagaaggtgttaagagccatatgagtgagcagtggcccaaagccatgcacatcagtggctcatttaaggaatgaatgccattagatgggctactgagagtacagggatattatggaagataaagttggaaaagctgaaggattgattttcttccatcaactctcaagatcccattcgccattcaatctctgtgctgcagtaagagcaatcttaaacagtataaatcacacacacacacacacacacacacacacacacacacaagtccctcaggaaaaattccaagctcttgagaagatcacatgagccccttcatgacctggcgcttgcttatttcttccaggacttctctcacttctatccagctattcccgtcagcaaatgaacctccaaagcagcacatggagcactgcatagactatttcctcagtgcgtaactcctccctgtctcctctttacctgagtaacttgtactcatccttcaatactccaactgaattttacttaccctgaaaagatttccatggctatccaccacccccctgcctgtgagactgagttaggtgccctttttcatgtctttcccccatcacggcacttaccatactgcgttgtaattgcctgtgtactcgtctgtataactactagactgtaagctccttgagggcagggactgtgtctatcttgttcacagttgtatccccagcacccagcacagtgcctggcatattgtaggtgcttaataaatatttgttgaatga

SEQ ID NO: 137452 - DNA, 674 bp, Homo sapiens
  Payload ID: 6908
  Gene Symbol: GRIA4
  Gene Name: glutamate receptor, ionotropic, AMPA 4
  ENST ID: ENST00000531986
  CDS Start-End: 428-674
gcgcgcagcccagtggcagaagagggctaggctgagagggaagccaggactgtaggagagggaggcagcccgtcctcctcacgaacctgcaaggatgcggcaggggcctgggggcatggggaggtactaaccccccggagcccccgattggggcttgcagacctggcccgtgggcggattttctgcctagcgcagccgagaagcagaggtgccaggaaaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccgcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgcct

SEQ ID NO: 137453 - DNA, 367 bp, Homo sapiens
  Payload ID: 6908
  Gene Symbol: GRIA4
  Gene Name: glutamate receptor, ionotropic, AMPA 4
  ENST ID: ENST00000527177
  CDS Start-End: 121-367
aggctctccagattcccgggctgtttgctgcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgcct

SEQ ID NO: 137454 - DNA, 5834 bp, Homo sapiens
  Payload ID: 6909
  Gene Symbol: GRID1
  Gene Name: glutamate receptor, ionotropic, delta 1
  Uniprot ID: Q9ULK0
  ENST ID: ENST00000327946
  CDS Start-End: 87-3116
actgcaccgggaccagcgcctccccgcttcgcgctgccctcggcctcgccccgggcccgggtggatgagccgcgcgcccgggggacatggaagcgctgacgctgtggcttctcccctggatatgccagtgcgtgtcggtgcgggccgactccatcatccacatcggtgccatcttcgaggagaacgcggccaaggacgacagggtgttccagttggcggtatccgacctgagcctcaacgatgacatcctgcagagcgagaagatcacctactccatcaaggtcatcgaggccaacaacccattccaggctgtgcaggaagcctgtgacctcatgacccaggggattttggccttggtcacgtccactggctgtgcatctgccaatgccctgcagtccctcacggatgccatgcacatcccacacctctttgtccagcgcaacccgggagggtcgccacgcaccgcatgccacctgaaccccagccccgatggtgaggcctacacactggcttcgagaccacccgtccgcctcaatgatgtcatgctcaggctggtgacggagctgcgctggcagaagttcgtcatgttctacgacagcgagtatgatatccgtgggcttcaaagctttctggaccaggcctcgcggctgggccttgacgtctctttacaaaaggtggacaagaacattagccacgtattcaccagcctcttcaccacgatgaagacagaggagctgaatcgctaccgggacacgcttcgccgcgccatcctgctgctcagcccacagggagcccactccttcatcaacgaggccgtggagaccaacctggcttccaaggacagccactgggtctttgtgaatgaggaaatcagtgacccggagatcctggatctggtccatagtgcccttggaaggatgaccgtggtccggcaaatctttccgtctgcaaaggacaatcagaaatgcacgaggaacaaccaccgcatctcctccctgctctgcgacccccaggaaggctacctccagatgctgcagatctccaacctctatctgtatgacagtgttctgatgctggccaacgcctttcacaggaagctggaggaccggaagtggcatagcatggcgagcctcaactgcatacggaaatccactaagccatggaatggtgggaggtccatgctggataccatcaaaaagggccacatcactggcctcactggggtgatggagtttcgggaggacagttcgaatccctatgtccagtttgaaatccttggcactacctatagtgagacttttggcaaagacatgcgcaagttggcgacatgggactcagagaagggcttgaatggcagcttgcaagagaggcccatgggcagccgcctccaaggattgactcttaaagtggtgactgtcttggaagagcctttcgtgatggtggctgagaacatcctaggacagcccaagcgctacaaagggttctccatagatgtcctggatgcactggccaaggctctgggctttaaatatgagatttaccaagcccctgatggcaggtacggtcaccagctccataacacctcctggaacgggatgatcggggagctcatcagcaagagagcagacttggccatctctgccatcaccatcaccccagagagggagagcgttgtggacttcagcaagcggtacatggactattcagtggggattctaattaagaagcccgaggagaaaatcagcatcttctccctctttgctccatttgatttcgctgtgtgggcctgcattgcagcagccatccctgtggttggtgtgctgatatttgtgttgaacaggatacaggctgtgagggctcagagtgctgcccagcccaggccgtcagcttctgccactctgcacagcgccatctggattgtctatggagccttcgtacagcaaggtggcgaatcttccgtgaactccatggccatgcgcatcgtgatgggcagctggtggctcttcacgctcattgtgtgctcctcctacacagccaaccttgctgccttcctcacagtgtccaggatggacaaccccataaggactttccaggacctgtccaaacaagtggaaatgtcttatggcactgtccgggattctgctgtatatgagtacttccgagccaagggcaccaaccccctggagcaggacagcacgtttgctgaactctggcggaccatcagcaagaacggaggggctgacaactgcgtgtccagtccttcagaaggcatcaggaaggcaaagaaggggaactacgccttcctgtgggatgtggccgtggtggaatacgcagccctgacggatgacgactgctcggtgactgtcatcggcaacagcatcagcagcaagggttacgggattgccctgcagcatggcagcccctacagggacctcttctcccagaggatcctggagctgcaggacacaggggacctggatgtgctgaagcagaagtggtggccgcacatgggccgctgtgacctcaccagccatgccagcgcccaggccgacggcaaatccctcaagctgcacagcttcgccggggtcttctgcatcctggccattggcctgctcctggcctgcctggtggctgccctggagttgtggtggaacagcaaccggtgccaccaggagacccccaaggaggacaaagaagtgaacttggagcaggtccaccggcgcatgaacagcctcatggatgaagacattgctcacaagcagatttccccagcgtcgattgagctctcggccctggagatggggggcctggctcccacccagaccttggagccgacacgggagtaccagaacacccagctctcggtcagcacctttctgccagagcagagcagccatggcaccagccggacactctcatcagggcccagcagcaacctgccgctgccgctgagcagctcggcgaccatgccctccatgcagtgcaaacacaggtcacccaacggggggctgttccggcagagcccggtgaagacccccatccccatgtccttccagcccgtgcctggaggcgtccttccagaggctctggacacctcccacgggacctccatctgactgcgccgcctgccctcctgcccaccctcccacccacccgaccagcagagctttttaatacaagaaaacaacaacacaaaccacacacactcgcacacacacacatacacagagactctttcatttttcttgtacatatgtgtaaataatgacagaatggagtggggtaaaagtgtattttgaatattcccaattttcgaagtcagtaaaaaaacacaaaaactgtatgaatgactttgtaaattttgttctatatgaataaaaaggcaaattacttgtgatcattctgaagtgccaaaggagcccccccattcctgggcctttctgagggcaggaggggcgaccagataaggagcccctctctgctgggggagaagggaagacgaggaaccccacatgccactcgctgccttgtcccacagcttgctgccccatttctttgctcctggcacctcgtcccttttagtccctcagcttgataaagagtgagtttggagcccgcattgggctggcccactgggttgctgtgctgtagggtgatcggctgttctgggtagcctggggctgaggaggtgccctggactcagggctatcctgtcctgtcttggatcttgcgggacgagttagtcaccgctgtgtgtgttgcagtgtgcctctgccccatgggcccgagagaagctgacaattacccatagtgaggtaattgagggctttgatactgagctgttctcatatcatactgttggccttgtttttcattttcttttcaaaattagaagaatcaaaaagtgatagaatattgggggaaggagggcagactccatcgtttcctcagggagactgggcggaggtggggttggtctggaagaaggtccatgggggcagggagttgcgaggtggggttagttgcatggaccaggtgaggtggtggaacaaaaggccaggtagaggaagaatattcccttgggtttggacccatggtcccaggtgagagaaggaagtgaggccatagatgcagggagtagaagctttgtggtgtcaggcaaacggactctgttagtaagagttgggggaggtgcccaggtgggtggaccagtactccaggtgatggggcatgctgagaaatagagaaaagagaccatgtttatttgggtaggaggaagccttgccttgcgccttaggtgagaagcataagtgtaactcccatccaccagggaagttgcttgtagccccaaaagtaaaggcctatctctgggtcataaatcctgcaggcagtccaacaaacagggctggctccagcacaaactctcccttccacctttacgaccctctccagaccagacctggagtcctcttcaagcagcaatccaacccagagcaggggccctccccactcaggcatctgataacctctgagatttccaggcctatccctgtgcaggtacagctgcagggaagcccagttttctaagcctaggaccacctaacagcgccccctccttcagttgccctttctgaggcaactaaactacagaatcagggaaagaaccattaggagtggaactgggggaatctgagttgtgtcacttcagttcctctcctaaagacaaaggttagtctgatctccagacccgtcagaatggaatacacagcccacatctgtcactgaaggaggtggagctcccacagccagcagtaatcagggagctgagagcctggttctgtgatcatggagaaatacaaagtcctattgattgcttcttctatagccttgtagagtttctagagagatgtatttatgagggtgataactagcccaggattgatttctttcctaaagtccctagtgacatgattgagcagtaaagaacggccaaatcacacagtcagctaaaagcactgtggggaagagagtgtttataattatgttatttattgctggatgctgagaatggtctgatattcgtgctacctaggcaatccattgacatttctccaatcagagcatgtggaccttggagccaggcatgctcagagaagcctaggtgggctaccatgaccccgaggaagagcaggctttgttttccatcagcacgttgggggccctgccctgaatggtcaatttttcacatatatatctctctatttttttaatcaaactctggtctcactgccttatctcacaccaactctgtttcctcattgccccctgagatggcctgtcttctggggtatagcttggatgtcttcttggatggttctgcttagaatgagtgtcaaggaggaaagagagggagatggaggatgtgtttgtgcgcctgtgtgtgtgtgtttgtgtgtgtgtgtgtgtgtgagagagagagagagagagagagagaccagcatcttcaagagaagtattctgcttatacaaaatccttaacacctcatggtgttattcttcaccatgtttatatatatatatatatatttttttttttttttagaattttctacccttggcatgaggggaaatgattgatattcaagcaagttctctaggaaaaaaaaaaacttcccaactcagatttctgtgtcagctcagaatgtatctttttttcatgctttgctctttggatttataactctgtttagactattccatacattttaggtatattttgtgccttcagacactgcaaataataatcagcatttggattaaagttgtttaataat

SEQ ID NO: 137455 - DNA, 3243 bp, Homo sapiens
  Payload ID: 6909
  Gene Symbol: GRID1
  Gene Name: glutamate receptor, ionotropic, delta 1
  ENST ID: ENST00000464741
  CDS Start-End: 102-2369
ggggagcggcccgggactgcaccgggaccagcgcctccccgcttcgcgctgccctcggcctcgccccgggcccgggtggatgagccgcgcgcccgggggacatggaagcgctgacgctgtggcttctcccctggatatgccagtgcgtgtcggtgcgggccgactccatcatccacatcggtgccatcttcgaggagaacgcggccaaggacgacagggtgttccagttggcggtatccgacctgagcctcaacgatgacatcctgcagagcgagaagatcacctactccatcaaggtcatcgaggccaacaacccattccaggctgtgcaggaagcctgtgacctcatgacccaggggattttggccttggtcacgtccactggctgtgcatctgccaatgccctgcagtccctcacggatgccatgcacatcccacacctctttgtccagcgcaacccgggagggtcgccacgcaccgcatgccacctgaaccccagccccgatggtgaggcctacacactggcttcgagaccacccgtccgcctcaatgatgtcatgctcaggctggtgacggagctgcgctggcagaagttcgtcatgttctacgacagcgagtatgatatccgtgggcttcaaagctttctggaccaggcctcgcggctgggccttgacgtctctttacaaaaggtggacaagaacattagccacgtattcaccagcctcttcaccacgatgaagacagaggagctgaatcgctaccgggacacgcttcgccgcgccatcctgctgctcagcccacagggagcccactccttcatcaacgaggccgtggagaccaacctggcttccaaggacagccactgggtctttgtgaatgaggaaatcagtgacccggagatcctggatctggtccatagtgcccttggaaggatgaccgtggtccggcaaatctttccgtctgcaaaggacaatcagaaatgcacgaggaacaaccaccgcatctcctccctgctctgcgacccccaggaaggctacctccagatgctgcagatctccaacctctatctgtatgacagtgttctgatgctggccaacgcctttcacaggaagctggaggaccggaagtggcatagcatggcgagcctcaactgcatacggaaatccactaagccatggaatggtgggaggtccatgctggataccatcaaaaagggccacatcactggcctcactggggtgatggagtttcgggaggacagttcgaatccctatgtccagtttgaaatccttggcactacctatagtgagacttttggcaaagacatgcgcaagttggcgacatgggactcagagaagggcttgaatggcagcttgcaagagaggcccatgggcagccgcctccaaggattgactcttaaagtggtgactgtcttggaagagcctttcgtgatggtggctgagaacatcctaggacagcccaagcgctacaaagggttctccatagatgtcctggatgcactggccaaggctctgggctttaaatatgagatttaccaagcccctgatggcaggtacggtcaccagctccataacacctcctggaacgggatgatcggggagctcatcagcaagagagcagacttggccatctctgccatcaccatcaccccagagagggagagcgttgtggacttcagcaagcggtacatggactattcagtggggattctaattaagaagcccgaggagaaaatcagcatcttctccctctttgctccatttgatttcgctgtgtgggcctgcattgcagcagccatccctgtggttggtgtgctgatatttgtgttgaacaggatacaggctgtgagggctcagagtgctgcccagcccaggccgtcagcttctgccactctgcacagcgccatctggattgtctatggagccttcgtacagcaaggtggcgaatcttccgtgaactccatggccatgcgcatcgtgatgggcagctggtggctcttcacgctcattgtgtgctcctcctacacagccaaccttgctgccttcctcacagtgtccaggatggacaaccccataaggactttccaggacctgtccaaacaagtggaaatgtcttatggcactgtccgggattctgctgtatatgagtacttccgagccaagggcaccaaccccctggagcaggacagcacgtttgctgaactctggcggaccatcagcaagaacggaggggctgacaactgcgtgtccagtccttcagaaggcatcaggaaggatcctggagctgcaggacacaggggacctggatgtgctgaagcagaagtggtggccgcacatgggccgctgtgacctcaccagccatgccagcgcccaggccgacggcaaatccctcaagctgcacagcttcgccggggtcttctgcatcctggccattggcctgctcctggcctgcctggtggctgccctggagttgtggtggaacagcaaccggtgccaccaggagacccccaaggaggacaaagaagtgaacttggagcaggtccaccggcgcatgaacagcctcatggatgaagacattgctcacaagcagatttccccagcgtcgattgagctctcggccctggagatggggggcctggctcccacccagaccttggagccgacacgggagtaccagaacacccagctctcggtcagcacctttctgccagagcagagcagccatggcaccagccggacactctcatcagggcccagcagcaacctgccgctgccgctgagcagctcggcgaccatgccctccatgcagtgcaaacacaggtcacccaacggggggctgttccggcagagcccggtgaagacccccatccccatgtccttccagcccgtgcctggaggcgtccttccagaggctctggacacctcccacgggacctccatctgactgcgccgcctgccctcctgcccaccctcccacccacccgaccagcagagctttttaatacaagaaaacaacaacacaaaccacacacactcgcacacacacacatacacagagactctttcatttttcttgtacatatgtgtaaataatgacagaatggagtggggtaaaagtgtattttgaatattcccaattttcgaagtcagtaaaaaaacacaaaaactgtatgaatgactttgtaaattttgttctatatgaataaaaaggcaaattacttgt

SEQ ID NO: 137456 - DNA, 5024 bp, Homo sapiens
  Payload ID: 6909
  Gene Symbol: GRID1
  Gene Name: glutamate receptor, ionotropic, delta 1
  ENST ID: ENST00000536331
  CDS Start-End: 57-2306
aggccgtggagaccaacctggcttccaaggacagccactgggtctttgtgaatgaggaaatcagtgacccggagatcctggatctggtccatagtgcccttggaaggatgaccgtggtccggcaaatctttccgtctgcaaaggacaatcagaaatgcacgaggaacaaccaccgcatctcctccctgctctgcgacccccaggaaggctacctccagatgctgcagatctccaacctctatctgtatgacagtgttctgatgctggccaacgcctttcacaggaagctggaggaccggaagtggcatagcatggcgagcctcaactgcatacggaaatccactaagccatggaatggtgggaggtccatgctggataccatcaaaaagggccacatcactggcctcactggggtgatggagtttcgggaggacagttcgaatccctatgtccagtttgaaatccttggcactacctatagtgagacttttggcaaagacatgcgcaagttggcgacatgggactcagagaagggcttgaatggcagcttgcaagagaggcccatgggcagccgcctccaaggattgactcttaaagtggtgactgtcttggaagagcctttcgtgatggtggctgagaacatcctaggacagcccaagcgctacaaagggttctccatagatgtcctggatgcactggccaaggctctgggctttaaatatgagatttaccaagcccctgatggcaggtacggtcaccagctccataacacctcctggaacgggatgatcggggagctcatcagcaagagagcagacttggccatctctgccatcaccatcaccccagagagggagagcgttgtggacttcagcaagcggtacatggactattcagtggggattctaattaagaagcccgaggagaaaatcagcatcttctccctctttgctccatttgatttcgctgtgtgggcctgcattgcagcagccatccctgtggttggtgtgctgatatttgtgttgaacaggatacaggctgtgagggctcagagtgctgcccagcccaggccgtcagcttctgccactctgcacagcgccatctggattgtctatggagccttcgtacagcaaggtggcgaatcttccgtgaactccatggccatgcgcatcgtgatgggcagctggtggctcttcacgctcattgtgtgctcctcctacacagccaaccttgctgccttcctcacagtgtccaggatggacaaccccataaggactttccaggacctgtccaaacaagtggaaatgtcttatggcactgtccgggattctgctgtatatgagtacttccgagccaagggcaccaaccccctggagcaggacagcacgtttgctgaactctggcggaccatcagcaagaacggaggggctgacaactgcgtgtccagtccttcagaaggcatcaggaaggcaaagaaggggaactacgccttcctgtgggatgtggccgtggtggaatacgcagccctgacggatgacgactgctcggtgactgtcatcggcaacagcatcagcagcaagggttacgggattgccctgcagcatggcagcccctacagggacctcttctcccagaggatcctggagctgcaggacacaggggacctggatgtgctgaagcagaagtggtggccgcacatgggccgctgtgacctcaccagccatgccagcgcccaggccgacggcaaatccctcaagctgcacagcttcgccggggtcttctgcatcctggccattggcctgctcctggcctgcctggtggctgccctggagttgtggtggaacagcaaccggtgccaccaggagacccccaaggaggacaaagaagtgaacttggagcaggtccaccggcgcatgaacagcctcatggatgaagacattgctcacaagcagatttccccagcgtcgattgagctctcggccctggagatggggggcctggctcccacccagaccttggagccgacacgggagtaccagaacacccagctctcggtcagcacctttctgccagagcagagcagccatggcaccagccggacactctcatcagggcccagcagcaacctgccgctgccgctgagcagctcggcgaccatgccctccatgcagtgcaaacacaggtcacccaacggggggctgttccggcagagcccggtgaagacccccatccccatgtccttccagcccgtgcctggaggcgtccttccagaggctctggacacctcccacgggacctccatctgactgcgccgcctgccctcctgcccaccctcccacccacccgaccagcagagctttttaatacaagaaaacaacaacacaaaccacacacactcgcacacacacacatacacagagactctttcatttttcttgtacatatgtgtaaataatgacagaatggagtggggtaaaagtgtattttgaatattcccaattttcgaagtcagtaaaaaaacacaaaaactgtatgaatgactttgtaaattttgttctatatgaataaaaaggcaaattacttgtgatcattctgaagtgccaaaggagcccccccattcctgggcctttctgagggcaggaggggcgaccagataaggagcccctctctgctgggggagaagggaagacgaggaaccccacatgccactcgctgccttgtcccacagcttgctgccccatttctttgctcctggcacctcgtcccttttagtccctcagcttgataaagagtgagtttggagcccgcattgggctggcccactgggttgctgtgctgtagggtgatcggctgttctgggtagcctggggctgaggaggtgccctggactcagggctatcctgtcctgtcttggatcttgcgggacgagttagtcaccgctgtgtgtgttgcagtgtgcctctgccccatgggcccgagagaagctgacaattacccatagtgaggtaattgagggctttgatactgagctgttctcatatcatactgttggccttgtttttcattttcttttcaaaattagaagaatcaaaaagtgatagaatattgggggaaggagggcagactccatcgtttcctcagggagactgggcggaggtggggttggtctggaagaaggtccatgggggcagggagttgcgaggtggggttagttgcatggaccaggtgaggtggtggaacaaaaggccaggtagaggaagaatattcccttgggtttggacccatggtcccaggtgagagaaggaagtgaggccatagatgcagggagtagaagctttgtggtgtcaggcaaacggactctgttagtaagagttgggggaggtgcccaggtgggtggaccagtactccaggtgatggggcatgctgagaaatagagaaaagagaccatgtttatttgggtaggaggaagccttgccttgcgccttaggtgagaagcataagtgtaactcccatccaccagggaagttgcttgtagccccaaaagtaaaggcctatctctgggtcataaatcctgcaggcagtccaacaaacagggctggctccagcacaaactctcccttccacctttacgaccctctccagaccagacctggagtcctcttcaagcagcaatccaacccagagcaggggccctccccactcaggcatctgataacctctgagatttccaggcctatccctgtgcaggtacagctgcagggaagcccagttttctaagcctaggaccacctaacagcgccccctccttcagttgccctttctgaggcaactaaactacagaatcagggaaagaaccattaggagtggaactgggggaatctgagttgtgtcacttcagttcctctcctaaagacaaaggttagtctgatctccagacccgtcagaatggaatacacagcccacatctgtcactgaaggaggtggagctcccacagccagcagtaatcagggagctgagagcctggttctgtgatcatggagaaatacaaagtcctattgattgcttcttctatagccttgtagagtttctagagagatgtatttatgagggtgataactagcccaggattgatttctttcctaaagtccctagtgacatgattgagcagtaaagaacggccaaatcacacagtcagctaaaagcactgtggggaagagagtgtttataattatgttatttattgctggatgctgagaatggtctgatattcgtgctacctaggcaatccattgacatttctccaatcagagcatgtggaccttggagccaggcatgctcagagaagcctaggtgggctaccatgaccccgaggaagagcaggctttgttttccatcagcacgttgggggccctgccctgaatggtcaatttttcacatatatatctctctatttttttaatcaaactctggtctcactgccttatctcacaccaactctgtttcctcattgccccctgagatggcctgtcttctggggtatagcttggatgtcttcttggatggttctgcttagaatgagtgtcaaggaggaaagagagggagatggaggatgtgtttgtgcgcctgtgtgtgtgtgtttgtgtgtgtgtgtgtgtgtgagagagagagagagagagagagagaccagcatcttcaagagaagtattctgcttatacaaaatccttaacacctcatggtgttattcttcaccatgtttatatatatatatatatatttttttttttttttagaattttctacccttggcatgaggggaaatgattgatattcaagcaagttctctaggaaaaaaaaaaacttcccaactcagatttctgtgtcagctcagaatgtatctttttttcatgctttgctctttggatttataactctgtttagactattccatacattttaggtatattttgtgccttcagacactgcaaataataatcagcatttggattaaagttgtttaataat

SEQ ID NO: 137457 - DNA, 6117 bp, Homo sapiens
  Payload ID: 6910
  Gene Symbol: GRID2
  Gene Name: glutamate receptor, ionotropic, delta 2
  Uniprot ID: O43424
  ENST ID: ENST00000282020
  CDS Start-End: 1036-4059
agtcccggttgaagattccatgggaaatgagagcactattttgtttctcccttgtattgcagatagggggaggaggtggttattagagagaagctcttcctctcttggtttccccctctctccgcctgacagcaccgctctctcgcaggctcgctccttctcctaggtgatccatttctaggcaacgtggggctggtgctgaagctgccaggctcgctccttgcttcctgcatcccgccaggcgaaacgctccaaaagcatcctgcagcctgcggcggcttccctcctctggcccggccccgctgctcgcgcccggcgcaacccccccgccaccgcgccccagcaaaccggctccccgggcccgcctcgccaagctgcgttccgcgcctcacgcagaaagggaattttctctgcattactatctgcattaccttgaagttcactttttctacccctcttggagagggcttttttcccccctccctggtggaatctggctgctccgtttggaatctcctaatctttcctttccacttagattctggcagcgaagaccagtgattctctgcgggctgtaggggcgggggcgggggtcttttttggtccgagagggtgcggggaagggggcacatccggcgtgaggggggtgttggaagttgcagcggagctgggaccggagacccgcggcccccgcgcagcgatgggtctgatctgagccccagcctctccccctgcccaagagcagtagaggctggatatatttttcaaaagccaaactgcaaacaactctggcgatgccaaaattcccctccaagtgacacggctttgcgaaggaggtttcctcaggctgggctctttctgtcattcccttctgcctttctcggcgacgataaaaggctttgctctggcaataggaatttagaaaaaaagaaaaagctgcgctaaactccaccgtgacctcaaactctttggactgtttgaaaaaaaaaaaattggaagaaaatccatcctccaagagaatcggcataggaggagatggaagttttcccctttctcttggttttgtccgtctggtggtctcgaacctgggactcggcgaatgcggattcgatcattcacatcggagcaatttttgatgaatctgccaaaaaggatgatgaggtatttcgcactgcggttggtgaccttaaccagaatgaggagatcttacagactgagaaaatcacattttcagtgacgtttgttgatggcaacaaccctttccaagcagttcaagaagcctgtgaacttatgaatcaaggcatcttggccctggtcagctccattggctgcacgtcagcaggatccctccagtctttggcagacgccatgcatatcccccacctcttcattcagcgctcaacagctgggaccccaaggagtggctgtggactcacccggagcaacaggaatgatgactacactctctcagttcgcccacctgtctacttgcatgatgttatcctaagagtggtcacagagtatgcctggcagaaattcattatattctatgatagtgaatacgatatccgtggaatacaggagttcttggacaaagtctctcagcagggaatggatgttgcacttcagaaggtagaaaacaacatcaataaaatgattaccactctctttgacaccatgagaatagaagaactgaatcgctatcgagacactcttaggcgagcgatccttgttatgaatcctgctacagccaaatccttcattactgaggttgtggagactaatttggttgcttttgactgtcactggatcattataaatgaggaaataaacgatgtggacgtacaggaacttgtaagaaggtcaattggaaggttaacgattattcggcagacatttccagttccccagaacataagtcagcggtgtttccgtggcaaccatcgaatatcttcaacattgtgtgatccaaaggatccatttgctcagaatatggagatttccaacctttacatatatgacacggtgcttctgcttgctaatgcttttcataagaagctggaggaccgaaagtggcacagcatggcaagtctgtcatgtatcagaaagaactcaaagccctggcagggtgggcgctccatgttggagaccatcaagaagggtggagttagtgggttgactggagagctagaatttggagaaaatggaggcaatcccaatgtccactttgaaatccttggaaccaactatggagaagagcttggcagaggtgttcgaaaacttggttgctggaatcctgtcacaggtctgaatgggtcactgactgacaagaaattggagaataacatgcgtggagtggttctacgtgtagtaactgttctggaagaaccttttgtgatggtctctgaaaatgtcttgggtaagccgaagaaataccagggcttctccattgatgttttggatgccttatctaactacctgggttttaactacgaaatttacgtagcaccggatcacaaatacggaagcccacaagaagatgggacatggaatggcttggtaggagaacttgtctttaagagagccgacatagggatttctgctttaaccatcactccagatcgtgaaaatgtggtggactttacgacacgttacatggactactcagtgggggtactacttcgaagggctgaaaagacagtggatatgtttgcctgtcttgcaccatttgatctctctctatgggcttgcattgctggcacagtccttctggtgggtctactggtctacctcttgaactggcttaatcccccacgattacaaatgggatcaatgacgtctactactctctacaactccatgtggtttgtgtatggatcttttgtacaacaaggcggggaagtcccgtacacgactctggctacccgaatgatgatgggggcttggtggctatttgctttgattgttatctcatcttacacggcaaacctcgctgctttcctcactattacacgcattgaaagttccatccagtctctccaggacctttccaagcaaacagaaatcccttatggcacagtcctagactctgcggtatatgagcatgtccgcatgaaaggactgaatccttttgagagggacagcatgtattcccaaatgtggcggatgatcaaccgaagcaatggatcggagaacaatgttctggagtcccaggcaggcattcaaaaggtaaaatatggaaattatgctttcgtatgggatgcagctgtattggaatatgtggctatcaatgacccagattgttccttttacaccattggaaatactgttgctgatcggggatatggaattgcattacaacatggcagtccttaccgagatgttttttcacaaaggatcctggagcttcagcagaatggtgacatggacatcctgaagcacaaatggtggcctaagaatggccagtgtgacctgtactcgtcagtggacacaaagcagaaaggaggcgccctggacataaagagctttgcaggggtcttttgtatcctggctgctggaattgtcctctcctgcttcatagccatgctggagacgtggtggaacaagaggaaaggctcccgggttccatcaaaagaggatgacaaggaaattgacctggagcacctccatagacgtgtaaatagcttgtgcacagatgacgacagcccccataaacagttttccacctcgtcaattgatttgacccctctggacattgacactttgccaacacgacaagcactggagcaaatcagtgatttcaggaacactcatattaccacaacaacctttatcccagagcagatccagactcttagccgcacactgtcagctaaagctgcttctggtttcacttttggcaacgtgcctgagcaccgaactggcccttttaggcacagggcacctaatgggggctttttcaggagtcctataaaaacaatgtcatctattccttatcaaccaactcctaccctggggctcaatctgggtaatgatccagaccgaggcacctccatatgagcatcaaacaaatctcttcactgtttcttttttaggactccctttgcaaggagcaactgtaatattgtgggactaacatggatgtaacgtttaaaaaaaagatcaggattattagtaacaattctagttttttcctcccaccttctccctctcctctctcctctatgattttctctctttccccctcccttcctgtacattttcctccactttttttcattactcaacttgttccccaagaaggtagtgtactaggatcctattagtctgcttttcatatactgtacatcaagtataggaaatgtgcactgagtatactaaaagtatatgcaggattaattttacataaaggcctcttctgtaacatttctctattttttgaaatacaattgcaataacttcagtctttttacattcttctgctgcatccatacaatgctccactgctgttgagtgtcctttaactgtggaccaaaggcaacccctgcagtgtttataaaacaattttaagaccattcaggccacataagatgagaatgcaattttgtaggattacaaaaaagccattaatatgccagtcaagactacagttaaaactactcttgcactgcaacagtgcatatgacctttatgtgattgtacagtattaaaagttttttcttatgtacagtaaactttatcatatggcagaagcctctattgtgttaaataaattagtatttcatatatatacatatatatgcacctatataatgtgtatatatataaaaaggcagccattgctattgcaattcatttaataaagctttagtttaaacaaaagtattgtatacaggaactatgtatagtgcaggggttcttttcagttagaaaaggcaggttgctttaatgttattctgactcgcattgtttgccaacagaaaatattttatacttttgttattaaagcatccagggcaatttaatatttgttcctagatgtaactcatttgaataggttttgcatttgttattcagcagtgtataaagctaaccttgataattttacttttaattaattatctaaatgaaaaatgctattagctgaaccacatccacaacagcacatagagctctagaagagttgaaacatagatcattgaaggttaaaaatcctcttccaaagcagcaagtcaatcaatacaataatgatatttggggaggggtgggagcccttaagaactattgatgtggccttaaattactgtcatttattatcctaaagaagaaaacataataaccataatgggctctcaactcaactcccttttttatttagttctatttggaggagttatgtattttttacattagtgccaagtatatagaaggatgacagcaaaaacagtgcctctttgtgcacaatccttttaaagtagcattcttacttgttagaaatgtagaatgaactttgtttgtaatccttaaattaaaatgtggtaagtaggaagcaagaacttattctgtgtttttacgcagccatacacttactttaatctaactcattctgtggctaggattgatataggaatcaacctatgtgatttgctttaggagaaattaaaaggtatattcttaagatatattatattttgatgctaattctgttctggggagcatcttgtattgtcactgttttgtactaaatcttcaaatattgtctactgtgtaaggcagaaaaatttcttatcatgcaaaaaccattttgtttccagggtaacaagtaactaagtgcatgcacaacttgttttcccttgtaacattcatgatctcatttacaactctgattttaaaacaaaaaaatctttacaacaagctatatagggacataccagatgttgcagtgattttagctatcaacaaactgttaaccatgtacaatatttaaaataggcttattttgatgtatcgcctattatacaaacacacaaaacatttttggaggcctcagttatgagtgacagagctttctgtgtataatttgtctaaataatttgtctaataaaaatgttttctaaa

SEQ ID NO: 137458 - DNA, 2739 bp, Homo sapiens
  Payload ID: 6910
  Gene Symbol: GRID2
  Gene Name: glutamate receptor, ionotropic, delta 2
  Uniprot ID: O43424
  ENST ID: ENST00000510992
  CDS Start-End: 1-2739
atggaagttttcccctttctcttggttttgtccgtctggtggtctcgaacctgggactcggcgaatgcggattcgatcattcacatcggagcaatttttgatgaatctgccaaaaaggatgatgaggtatttcgcactgcggttggtgaccttaaccagaatgaggagatcttacagactgagaaaatcacattttcagtgacgtttgttgatggcaacaaccctttccaagcagttcaagaagatatccgtggaatacaggagttcttggacaaagtctctcagcagggaatggatgttgcacttcagaaggtagaaaacaacatcaataaaatgattaccactctctttgacaccatgagaatagaagaactgaatcgctatcgagacactcttaggcgagcgatccttgttatgaatcctgctacagccaaatccttcattactgaggttgtggagactaatttggttgcttttgactgtcactggatcattataaatgaggaaataaacgatgtggacgtacaggaacttgtaagaaggtcaattggaaggttaacgattattcggcagacatttccagttccccagaacataagtcagcggtgtttccgtggcaaccatcgaatatcttcaacattgtgtgatccaaaggatccatttgctcagaatatggagatttccaacctttacatatatgacacggtgcttctgcttgctaatgcttttcataagaagctggaggaccgaaagtggcacagcatggcaagtctgtcatgtatcagaaagaactcaaagccctggcagggtgggcgctccatgttggagaccatcaagaagggtggagttagtgggttgactggagagctagaatttggagaaaatggaggcaatcccaatgtccactttgaaatccttggaaccaactatggagaagagcttggcagaggtgttcgaaaacttggttgctggaatcctgtcacaggtctgaatgggtcactgactgacaagaaattggagaataacatgcgtggagtggttctacgtgtagtaactgttctggaagaaccttttgtgatggtctctgaaaatgtcttgggtaagccgaagaaataccagggcttctccattgatgttttggatgccttatctaactacctgggttttaactacgaaatttacgtagcaccggatcacaaatacggaagcccacaagaagatgggacatggaatggcttggtaggagaacttgtctttaagagagccgacatagggatttctgctttaaccatcactccagatcgtgaaaatgtggtggactttacgacacgttacatggactactcagtgggggtactacttcgaagggctgaaaagacagtggatatgtttgcctgtcttgcaccatttgatctctctctatgggcttgcattgctggcacagtccttctggtgggtctactggtctacctcttgaactggcttaatcccccacgattacaaatgggatcaatgacgtctactactctctacaactccatgtggtttgtgtatggatcttttgtacaacaaggcggggaagtcccgtacacgactctggctacccgaatgatgatgggggcttggtggctatttgctttgattgttatctcatcttacacggcaaacctcgctgctttcctcactattacacgcattgaaagttccatccagtctctccaggacctttccaagcaaacagaaatcccttatggcacagtcctagactctgcggtatatgagcatgtccgcatgaaaggactgaatccttttgagagggacagcatgtattcccaaatgtggcggatgatcaaccgaagcaatggatcggagaacaatgttctggagtcccaggcaggcattcaaaaggtaaaatatggaaattatgctttcgtatgggatgcagctgtattggaatatgtggctatcaatgacccagattgttccttttacaccattggaaatactgttgctgatcggggatatggaattgcattacaacatggcagtccttaccgagatgttttttcacaaaggatcctggagcttcagcagaatggtgacatggacatcctgaagcacaaatggtggcctaagaatggccagtgtgacctgtactcgtcagtggacacaaagcagaaaggaggcgccctggacataaagagctttgcaggggtcttttgtatcctggctgctggaattgtcctctcctgcttcatagccatgctggagacgtggtggaacaagaggaaaggctcccgggttccatcaaaagaggatgacaaggaaattgacctggagcacctccatagacgtgtaaatagcttgtgcacagatgacgacagcccccataaacagttttccacctcgtcaattgatttgacccctctggacattgacactttgccaacacgacaagcactggagcaaatcagtgatttcaggaacactcatattaccacaacaacctttatcccagagcagatccagactcttagccgcacactgtcagctaaagctgcttctggtttcacttttggcaacgtgcctgagcaccgaactggcccttttaggcacagggcacctaatgggggctttttcaggagtcctataaaaacaatgtcatctattccttatcaaccaactcctaccctggggctcaatctgggtaatgatccagaccgaggcacctccatatga

SEQ ID NO: 137459 - DNA, 768 bp, Homo sapiens
  Payload ID: 6910
  Gene Symbol: GRID2
  Gene Name: glutamate receptor, ionotropic, delta 2
  ENST ID: ENST00000502699
  CDS Start-End: 86-577
aacgaggatgccactcagagagaccagagggacaaacaccacagccagtcctgccacagccctgccacaaaaaacctgtgaacttatgaatcaaggcatcttggccctggtcagctccattggctgcacgtcagcaggatccctccagtctttggcagacgccatgcatatcccccacctcttcattcagcgctcaacagctgggaccccaaggagtggctgtggactcacccggagcaacaggaatgatgactacactctctcagttcgcccacctgtctacttgcatgatgttatcctaagagtggtcacagagtatgcctggcagaaattcattatattctatgatagtgaatacgatatccgtggaatacaggagttcttggacaaagtctctcagcagggaatggatgttgcacttcagaaggtagaaaacaacatcaataaaatgattaccactctctttgacaccatgagaatagaagaactgaatcgctatcgagacactcttaggcgagcgatccttgttatgaatcctgctacagccaaatccttcattactgagatgtcgttttagaaaaacacttagggaggaaagaatgtgagtgatttttgttttcatgccagagcacagacacttacgtgacaattggagtaaataaagtaaaaggagcaaatgaaagttgagtgggattcacatagcctgcagtcttcatgatttccacatggaaagagagaattggagctagcatttaaacactaacatac

SEQ ID NO: 137460 - DNA, 579 bp, Homo sapiens
  Payload ID: 6910
  Gene Symbol: GRID2
  Gene Name: glutamate receptor, ionotropic, delta 2
  ENST ID: ENST00000512631
  CDS Start-End: 361-579
acatggccttgtaataccctgcagtggaggatgggaaatgtagtctagctgagtgtcccagcagaaggagagaatggattttgatgatcatctagcagtttctaccacatgaacccttgactttgcttaaaaattgaggttgtggagactaatttggttgcttttgactgtcactggatcattataaatgaggaaataaacgatgtggacgtacaggaacttgtaagaaggtcaattggaaggttaacgattattcggcagacatttccagttccccagaacataagtcagcggtgtttccgtggcaaccatcgaatatcttcaacattgtgtgatccaaaggatccatttgctcagaatatggagatttccaacctttacatatatgacacggtgcttctgcttgctaatgcttttcataagaagctggaggaccgaaagtggcacagcatggcaagtctgtcatgtatcagaaagaactcaaagccctggcagggtgggcgctccatgttggagaccatcaagaagggtggagttagtgggttgactggagagctagaatttggagaaaatggaggc

SEQ ID NO: 137461 - DNA, 443 bp, Homo sapiens
  Payload ID: 6910
  Gene Symbol: GRID2
  Gene Name: glutamate receptor, ionotropic, delta 2
  ENST ID: ENST00000513976
  CDS Start-End: 1-189
ggtggagttagtgggttgactggagagctagaatttggagaaaatggaggcaatcccaatgtccactttgaaatccttggaaccaactatggagaagagcttggcagaggtgttcgaaaaaatgaaagaatcagaccacagggctctactgggaaaatctggccccaggtaaacttcattttcaagtaatttgaccattcatatacattcatcttctgtacacttgcaaagtttgccaaactaaagcacagcagaacaacaacaaaatgttctttccctgaaacagagagagcccaggctaagccagagataacaaggagttgagactaccaaaagaatgctgacttctaaaggttgggctaagagaagagcttttatgtttaggtagaaacaggatgctgattttaaaaaaacttcttcattcattaaacattttccagatg

SEQ ID NO: 137462 - DNA, 4844 bp, Homo sapiens
  Payload ID: 6910
  Gene Symbol: GRID2
  Gene Name: glutamate receptor, ionotropic, delta 2
  ENST ID: ENST00000611049
  CDS Start-End: 9-2789
ttcttgcagcctgtgaacttatgaatcaaggcatcttggccctggtcagctccattggctgcacgtcagcaggatccctccagtctttggcagacgccatgcatatcccccacctcttcattcagcgctcaacagctgggaccccaaggagtggctgtggactcacccggagcaacaggaatgatgactacactctctcagttcgcccacctgtctacttgcatgatgttatcctaagagtggtcacagagtatgcctggcagaaattcattatattctatgatagtgaatacgatatccgtggaatacaggagttcttggacaaagtctctcagcagggaatggatgttgcacttcagaaggtagaaaacaacatcaataaaatgattaccactctctttgacaccatgagaatagaagaactgaatcgctatcgagacactcttaggcgagcgatccttgttatgaatcctgctacagccaaatccttcattactgaggttgtggagactaatttggttgcttttgactgtcactggatcattataaatgaggaaataaacgatgtggacgtacaggaacttgtaagaaggtcaattggaaggttaacgattattcggcagacatttccagttccccagaacataagtcagcggtgtttccgtggcaaccatcgaatatcttcaacattgtgtgatccaaaggatccatttgctcagaatatggagatttccaacctttacatatatgacacggtgcttctgcttgctaatgcttttcataagaagctggaggaccgaaagtggcacagcatggcaagtctgtcatgtatcagaaagaactcaaagccctggcagggtgggcgctccatgttggagaccatcaagaagggtggagttagtgggttgactggagagctagaatttggagaaaatggaggcaatcccaatgtccactttgaaatccttggaaccaactatggagaagagcttggcagaggtgttcgaaaacttggttgctggaatcctgtcacaggtctgaatgggtcactgactgacaagaaattggagaataacatgcgtggagtggttctacgtgtagtaactgttctggaagaaccttttgtgatggtctctgaaaatgtcttgggtaagccgaagaaataccagggcttctccattgatgttttggatgccttatctaactacctgggttttaactacgaaatttacgtagcaccggatcacaaatacggaagcccacaagaagatgggacatggaatggcttggtaggagaacttgtctttaagagagccgacatagggatttctgctttaaccatcactccagatcgtgaaaatgtggtggactttacgacacgttacatggactactcagtgggggtactacttcgaagggctgaaaagacagtggatatgtttgcctgtcttgcaccatttgatctctctctatgggcttgcattgctggcacagtccttctggtgggtctactggtctacctcttgaactggcttaatcccccacgattacaaatgggatcaatgacgtctactactctctacaactccatgtggtttgtgtatggatcttttgtacaacaaggcggggaagtcccgtacacgactctggctacccgaatgatgatgggggcttggtggctatttgctttgattgttatctcatcttacacggcaaacctcgctgctttcctcactattacacgcattgaaagttccatccagtctctccaggacctttccaagcaaacagaaatcccttatggcacagtcctagactctgcggtatatgagcatgtccgcatgaaaggactgaatccttttgagagggacagcatgtattcccaaatgtggcggatgatcaaccgaagcaatggatcggagaacaatgttctggagtcccaggcaggcattcaaaaggtaaaatatggaaattatgctttcgtatgggatgcagctgtattggaatatgtggctatcaatgacccagattgttccttttacaccattggaaatactgttgctgatcggggatatggaattgcattacaacatggcagtccttaccgagatgttttttcacaaaggatcctggagcttcagcagaatggtgacatggacatcctgaagcacaaatggtggcctaagaatggccagtgtgacctgtactcgtcagtggacacaaagcagaaaggaggcgccctggacataaagagctttgcaggggtcttttgtatcctggctgctggaattgtcctctcctgcttcatagccatgctggagacgtggtggaacaagaggaaaggctcccgggttccatcaaaagaggatgacaaggaaattgacctggagcacctccatagacgtgtaaatagcttgtgcacagatgacgacagcccccataaacagttttccacctcgtcaattgatttgacccctctggacattgacactttgccaacacgacaagcactggagcaaatcagtgatttcaggaacactcatattaccacaacaacctttatcccagagcagatccagactcttagccgcacactgtcagctaaagctgcttctggtttcacttttggcaacgtgcctgagcaccgaactggcccttttaggcacagggcacctaatgggggctttttcaggagtcctataaaaacaatgtcatctattccttatcaaccaactcctaccctggggctcaatctgggtaatgatccagaccgaggcacctccatatgagcatcaaacaaatctcttcactgtttcttttttaggactccctttgcaaggagcaactgtaatattgtgggactaacatggatgtaacgtttaaaaaaaagatcaggattattagtaacaattctagttttttcctcccaccttctccctctcctctctcctctatgattttctctctttccccctcccttcctgtacattttcctccactttttttcattactcaacttgttccccaagaaggtagtgtactaggatcctattagtctgcttttcatatactgtacatcaagtataggaaatgtgcactgagtatactaaaagtatatgcaggattaattttacataaaggcctcttctgtaacatttctctattttttgaaatacaattgcaataacttcagtctttttacattcttctgctgcatccatacaatgctccactgctgttgagtgtcctttaactgtggaccaaaggcaacccctgcagtgtttataaaacaattttaagaccattcaggccacataagatgagaatgcaattttgtaggattacaaaaaagccattaatatgccagtcaagactacagttaaaactactcttgcactgcaacagtgcatatgacctttatgtgattgtacagtattaaaagttttttcttatgtacagtaaactttatcatatggcagaagcctctattgtgttaaataaattagtatttcatatatatacatatatatgcacctatataatgtgtatatatataaaaaggcagccattgctattgcaattcatttaataaagctttagtttaaacaaaagtattgtatacaggaactatgtatagtgcaggggttcttttcagttagaaaaggcaggttgctttaatgttattctgactcgcattgtttgccaacagaaaatattttatacttttgttattaaagcatccagggcaatttaatatttgttcctagatgtaactcatttgaataggttttgcatttgttattcagcagtgtataaagctaaccttgataattttacttttaattaattatctaaatgaaaaatgctattagctgaaccacatccacaacagcacatagagctctagaagagttgaaacatagatcattgaaggttaaaaatcctcttccaaagcagcaagtcaatcaatacaataatgatatttggggaggggtgggagcccttaagaactattgatgtggccttaaattactgtcatttattatcctaaagaagaaaacataataaccataatgggctctcaactcaactcccttttttatttagttctatttggaggagttatgtattttttacattagtgccaagtatatagaaggatgacagcaaaaacagtgcctctttgtgcacaatccttttaaagtagcattcttacttgttagaaatgtagaatgaactttgtttgtaatccttaaattaaaatgtggtaagtaggaagcaagaacttattctgtgtttttacgcagccatacacttactttaatctaactcattctgtggctaggattgatataggaatcaacctatgtgatttgctttaggagaaattaaaaggtatattcttaagatatattatattttgatgctaattctgttctggggagcatcttgtattgtcactgttttgtactaaatcttcaaatattgtctactgtgtaaggcagaaaaatttcttatcatgcaaaaaccattttgtttccagggtaacaagtaactaagtgcatgcacaacttgttttcccttgtaacattcatgatctcatttacaactctgattttaaaacaaaaaaatctttacaacaagctatatagggacataccagatgttgcagtgattttagctatcaacaaactgttaaccatgtacaatatttaaaataggcttattttgatgtatcgcctattatacaaacacacaaaacatttttggaggcctcagttatgagtgacagagctttctgtgtataatttgtctaaataatttgtctaataaaaatgttttct

SEQ ID NO: 137463 - DNA, 3636 bp, Homo sapiens
  Payload ID: 6911
  Gene Symbol: GRID2IP
  Gene Name: glutamate receptor, ionotropic, delta 2 (Grid2) interacting protein
  Uniprot ID: A4D2P6
  ENST ID: ENST00000457091
  CDS Start-End: 1-3636
atggccaccactgccacgccggccacgaaccagggctggccagaggactttggcttccggctaggtggctctggcccctgcttcgtcctggaggtggccaaggggagcagcgcgcatgccggaggactgcggccaggagaccagatcctggaggtggaggggctggcggtgggcggtctgagccgcgagcgcctcgtgcgcctggcacggcgctgcccacgtgtgccgcccagtctgggcgtgctcccggctcccgacggtggccccggcccaggatccggccccgcggccccgaccacagtcttgcgggccccgcggtgcggccgcggcctagctctgggccgtgagctgcttcgcctggccggccgcaagcgcccggacgcggtgcaccgagagcgcaggcgcaaggcccaagagttcagccgcaaggtggatgaaatcttgggggaccagccaactgccaaggagcaggtgttcgctgcactgaagcagtttgcagctgagcagcgggtggatgatctggtgtggactctcaccctggcgctgccccgagaggcctgcgggccactcctggacaacctcaggatcttcatccccaagaagcaccgggcgcgcttcgacgaggtggtgtctcagggcctcctgggcaagctgtgccgcgcacgccgggcccagggcgcgcagcgactgcgccggagccgcagcgaggagcggccggagcgcctcctggtgtccacgcgcgccagcgccccgccgcgccgccccgatgagccgcccccgcgcagggcctccttgctggtgggcggcctcgccggccccgggggcgcgcgcaggactgtccgagtctacaaaggcaacaagagcttcggcttcacacttcgcggccacgggcctgtctggatcgagtctgtcctgcctgggagcccagctgacaatgctgccctcaagtcaggtgaccggatcctcttcctcaatggactggacatgaggaactgctcccacgacaaggtggtgtccatgctgcagggcagtggtgccatgcccacgctggtggtggaggaagggctcgtcccatttgccagtgactccgattctctggactcacccaacccgtcgtcggcgctcacctccctgcagtgggtggcggagatcctgccgtccagcatccgggtccaagggaggaccttcagccagcagctggagcacctactcacacctcctgagcgctatggggtctgccgggccctcgagagcttcttccagcacaggaacatcgacaccctcatcgttgacgtctaccctgtgctggacacccctgccaagcaggtcctgtggcagttcatctaccagctgctgacctatgaggagcaggagctctgtcaggagaaaatcgcatgcttcctgggctacacggccatgacagcagagccggagcctgagctggacctggagtccgagcccacgcctgagccccagccgcggagctccctgcgggcttcctccatgtgccgccgcagcctccggtcccagggcctggaggccggcctcagctgcggtcccagcgagtgccctgagatgcctcttcccctgatcccaggcgagcgccaggcaggcgacggcacgtccctccctgagacccccaaccccaagatgatgtcagccgtctatgcagagcttgagtctcgactgaacagcagcttcaaagggaagatggggaccgtgtccaaatcccgggcttcccctccaggccccagcccagcagtcaccacagggcccaggaccctgtccggcgtctcatggcccagcgagcgactcttgccctccccctgctaccacccgctgtgttcggggggtctggcctcccccagcagctctgagtcccacccctacgccagcctggacagcagcagggcaccctccccacagccaggccccgggcccatctgccccgacagccccccaagcccggaccccacccgcccgcccagccgcaggaagctcttcaccttctcccaccctgtgcgaagccgcgatactgaccgcttcctggacgtgctgagcgagcagctgggcccccgggtcaccatcgtggatgatttcctgaccccggagaacgactacgaggagatgagcttccatgatgaccagggcagcttcgtaaccaatgagcggagcagcgccagcgactgcatcagcagcagtgaagaaggcagctccctgacctactcctccatctctgaccacatccccccacccccgctcagccccccaccaccgccacccctgcctttccatgacgctaagcccagctcccgcagctctgatggttcccggggccctgctcaggcgctggccaagcccctcacccaactcagccacccagtccctccaccacccccaccgcccctgcccccacccgtgccctgtgcaccccccatgctgtcccggggcctgggccaccggcgcagtgagaccagccacatgagcgtcaagcgcttgcggtgggaacaggtggagaactcagaaggcaccatctggggtcagctcggggaagactctgactacgataagctgagtgacatggtgaaatacctcgacctggagctccacttcggcacccagaaacctgctaaaccggtgccggggccggagcccttccggaagaaggaggtggtggagatcctgtcccataagaaggcctacaacacctccatcctcttggcacacctgaagctgagccccgcggagctgcgccaggtgctgatgagcatggagccccggcgcctggagcccgcacatctcgcgcagctgctgctcttcgcgcccgacgccgacgaggagcagcgctaccaggccttccgcgaggcgcccggccgcctcagcgagccggaccagttcgtcctgcagatgctgtcagttcccgaatacaagacacgcctgcgcagcctccacttccaggccaccctccaggagaagacagaggagatccgaggcagccttgaatgcttgcgccaggcctccctggagctcaaaaacagtcggaagctcgccaagatcctggagtttgtgttggccatgggcaactatctcaacgatggacagcccaaaaccaacaagactacgggcttcaagatcaactttctgacagagctgaactccaccaagacagtggatgggaagtccaccttcctgcacatccttgccaaatcgctgagccagcacttccctgaactcctgggctttgctcaggacctgcccaccgtgcccctggctgccaaagtgaaccaacgggccctgaccagtgacctggctgacctccatggcactatcagcgagatacaggatgcctgccagagcatttccccctctagcgaggacaagtttgcaatggtcatgtcgtccttcctggagacggcccagccagcacttcgggcgctcgacgggctgcagcgcgaggccatggaggagctgggcaaggcgctggccttctttggggaggattccaaggccaccacctctgaggctttcttcggcatctttgcagagttcatgagcaaattcgagcgagcgctgagtgacctgcaggccggggagggcctgcgcagctccgggatggtttcacccctggcctggtga

SEQ ID NO: 137464 - DNA, 3428 bp, Homo sapiens
  Payload ID: 6911
  Gene Symbol: GRID2IP
  Gene Name: glutamate receptor, ionotropic, delta 2 (Grid2) interacting protein
  ENST ID: ENST00000452113
  CDS Start-End: 54-3116
cagctctcggctctgcagcggagcataggcgaccaccaccgaaagaggccaccatgagctgcctggggatcttcatccccaagaagcaccgggcgcgcttcgacgaggtggtgtctcagggcctcctgggcaagctgtgccgcgcacgccgggcccagggcgcgcagcgactgcgccggagccgcagcgaggagcggccggagcgcctcctggtgtccacgcgcgccagcgccccgccgcgccgccccgatgagccgcccccgcgcagggcctccttgctggtgggcggcctcgccggccccgggggcgcgcgcaggactgtccgagtctacaaaggcaacaagagcttcggcttcacacttcgcggccacgggcctgtctggatcgagtctgtcctgcctgggagcccagctgacaatgctgccctcaagtcaggtgaccggatcctcttcctcaatggactggacatgaggaactgctcccacgacaaggtggtgtccatgctgcagggcagtggtgccatgcccacgctggtggtggaggaagggctcgtcccatttgccagtgactccgattctctggactcacccaacccgtcgtcggcgctcacctccctgcagtgggtggcggagatcctgccgtccagcatccgggtccaagggaggaccttcagccagcagctggagcacctactcacacctcctgagcgctatggggtctgccgggccctcgagagcttcttccagcacaggaacatcgacaccctcatcgttgacgtctaccctgtgctggacacccctgccaagcaggtcctgtggcagttcatctaccagctgctgacctatgaggagcaggagctctgtcaggagaaaatcgcatgcttcctgggctacacggccatgacagagccggagcctgagctggacctggagtccgagcccacgcctgagccccagccgcggagctccctgcgggcttcctccatgtgccgccgcagcctccggtcccagggcctggaggccggcctcagctgcggtcccagcgagtgccctgagatgcctcttcccctgatcccaggcgagcgccaggcaggcgacggcacgtccctccctgagacccccaaccccaagatgatgtcagccgtctatgcagagcttgagtctcgactgaacagcagcttcaaagggaagatggggaccgtgtccaaatcccgggcttcccctccaggccccagcccagcagtcaccacagggcccaggaccctgtccggcgtctcatggcccagcgagcgactcttgccctccccctgctaccacccgctgtgttcggggggtctggcctcccccagcagctctgagtcccacccctacgccagcctggacagcagcagggcaccctccccacagccaggccccgggcccatctgccccgacagccccccaagcccggaccccacccgcccgcccagccgcaggaagctcttcaccttctcccaccctgtgcgaagccgcgatactgaccgcttcctggacgtgctgagcgagcagctgggcccccgggtcaccatcgtggatgatttcctgaccccggagaacgactacgaggagatgagcttccatgatgaccagggcagcttcgtaaccaatgagcggagcagcgccagcgactgcatcagcagcagtgaagaaggcagctccctgacctactcctccatctctgaccacatccccccacccccgctcagccccccaccaccgccacccctgcctttccatgacgctaagcccagctcccgcagctctgatggttcccggggccctgctcaggcgctggccaagcccctcacccaactcagccacccagtccctccaccacccccaccgcccctgcccccacccgtgccctgtgcaccccccatgctgtcccggggcctgggccaccggcgcagtgagaccagccacatgagcgtcaagcgcttgcggtgggaacaggtggagaactcagaaggcaccatctggggtcagctcggggaagactctgactacgataagctgagtgacatggtgaaatacctcgacctggagctccacttcggcacccagaaacctgctaaaccggtgccggggccggagcccttccggaagaaggaggtggtggagatcctgtcccataagaaggcctacaacacctccatcctcttggcacacctgaagctgagccccgcggagctgcgccaggtgctgatgagcatggagccccggcgcctggagcccgcacatctcgcgcagctgctgctcttcgcgcccgacgccgacgaggagcagcgctaccaggccttccgcgaggcgcccggccgcctcagcgagccggaccagttcgtcctgcagatgctgtcagttcccgaatacaagacacgcctgcgcagcctccacttccaggccaccctccaggagaagacagaggagatccgaggcagccttgaatgcttgcgccaggcctccctggagctcaaaaacagtcggaagctcgccaagatcctggagtttgtgttggccatgggcaactatctcaacgatggacagcccaaaaccaacaagactacgggcttcaagatcaactttctgacagagctgaactccaccaagacagtggatgggaagtccaccttcctgcacatccttgccaaatcgctgagccagcacttccctgaactcctgggctttgctcaggacctgcccaccgtgcccctggctgccaaagtgaaccaacgggccctgaccagtgacctggctgacctccatggcactatcagcgagatacaggatgcctgccagagcatttccccctctagcgaggacaagtttgcaatggtcatgtcgtccttcctggagacggcccagccagcacttcgggcgctcgacgggctgcagcgcgaggccatggaggagctgggcaaggcgctggccttctttggggaggattccaaggccaccacctctgaggctttcttcggcatctttgcagagttcatgagcaaattcgagcgagcgctgagtgacctgcaggccggggagggcctgcgcagctccgggatggtttcacccctggcctggtgacagtggccacaccgcgtcctctgcggcctgagcagggagatggaggccgagagggcagcccagacactgccgaggtccggggccactgtgccccgggctctgagcacaccgccagcctctcctgcagctacctcagccgccgagctgtggtcgggccctcctctgccagcccttgttcctacccccaggcccagagccagatgctgtaggagcaggtgctgagtgtgcctgcacatggaggaccgtgctctgtcggcttcttgggcccacttcccacttcgctcccaggctgtcaggggggcctggagggtg

SEQ ID NO: 137465 - DNA, 3215 bp, Homo sapiens
  Payload ID: 6911
  Gene Symbol: GRID2IP
  Gene Name: glutamate receptor, ionotropic, delta 2 (Grid2) interacting protein
  ENST ID: ENST00000435185
  CDS Start-End: 85-3168
ggagtcgcggcgcgctcgctccattcctgggctcggctaccccctgcccttcggcacctgccgcgccgcggtccccggctccagatggggaaggaccagggcttctctcggcactttcggatcttcatccccaagaagcaccgggcgcgcttcgacgaggtggtgtctcagggcctcctgggcaagctgtgccgcgcacgccgggcccagggcgcgcagcgactgcgccggagccgcagcgaggagcggccggagcgcctcctggtgtccacgcgcgccagcgccccgccgcgccgccccgatgagccgcccccgcgcagggcctccttgctggtgggcggcctcgccggccccgggggcgcgcgcaggactgtccgagtctacaaaggcaacaagagcttcggcttcacacttcgcggccacgggcctgtctggatcgagtctgtcctgcctgggagcccagctgacaatgctgccctcaagtcaggtgaccggatcctcttcctcaatggactggacatgaggaactgctcccacgacaaggtggtgtccatgctgcagggcagtggtgccatgcccacgctggtggtggaggaagggctcgtcccatttgccagtgactccgattctctggactcacccaacccgtcgtcggcgctcacctccctgcagtgggtggcggagatcctgccgtccagcatccgggtccaagggaggaccttcagccagcagctggagcacctactcacacctcctgagcgctatggggtctgccgggccctcgagagcttcttccagcacaggaacatcgacaccctcatcgttgacgtctaccctgtgctggacacccctgccaagcaggtcctgtggcagttcatctaccagctgctgacctatgaggagcaggagctctgtcaggagaaaatcgcatgcttcctgggctacacggccatgacagagccggagcctgagctggacctggagtccgagcccacgcctgagccccagccgcggagctccctgcgggcttcctccatgtgccgccgcagcctccggtcccagggcctggaggccggcctcagctgcggtcccagcgagtgccctgagatgcctcttcccctgatcccaggcgagcgccaggcaggcgacggcacgtccctccctgagacccccaaccccaagatgatgtcagccgtctatgcagagcttgagtctcgactgaacagcagcttcaaagggaagatggggaccgtgtccaaatcccgggcttcccctccaggccccagcccagcagtcaccacagggcccaggaccctgtccggcgtctcatggcccagcgagcgactcttgccctccccctgctaccacccgctgtgttcggggggtctggcctcccccagcagctctgagtcccacccctacgccagcctggacagcagcagggcaccctccccacagccaggccccgggcccatctgccccgacagccccccaagcccggaccccacccgcccgcccagccgcaggaagctcttcaccttctcccaccctgtgcgaagccgcgatactgaccgcttcctggacgtgctgagcgagcagctgggcccccgggtcaccatcgtggatgatttcctgaccccggagaacgactacgaggagatgagcttccatgatgaccagggcagcttcgtaaccaatgagcggagcagcgccagcgactgcatcagcagcagtgaagaaggcagctccctgacctactcctccatctctgaccacatccccccacccccgctcagccccccaccaccgccacccctgcctttccatgacgctaagcccagctcccgcagctctgatggttcccggggccctgctcaggcgctggccaagcccctcacccaactcagccacccagtccctccaccacccccaccgcccctgcccccacccgtgccctgtgcaccccccatgctgtcccggggcctgggccaccggcgcagtgagaccagccacatgagcgtcaagcgcttgcggtgggaacaggtggagaactcagaaggcaccatctggggtcagctcggggaagactctgactacgataagctgagtgacatggtgaaatacctcgacctggagctccacttcggcacccagaaacctgctaaaccggtgccggggccggagcccttccggaagaaggaggtggtggagatcctgtcccataagaaggcctacaacacctccatcctcttggcacacctgaagctgagccccgcggagctgcgccaggtgctgatgagcatggagccccggcgcctggagcccgcacatctcgcgcagctgctgctcttcgcgcccgacgccgacgaggagcagcgctaccaggccttccgcgaggcgcccggccgcctcagcgagccggaccagttcgtcctgcagatgctgtcagttcccgaatacaagacacgcctgcgcagcctccacttccaggccaccctccaggagaagacagaggagatccgaggcagccttgaatgcttgcgccaggcctccctggagctcaaaaacagtcggaagctcgccaagatcctggagtttgtgttggccatgggcaactatctcaacgatggacagcccaaaaccaacaagactacgggcttcaagatcaactttctgacagagctgaactccaccaagacagtggatgggaagtccaccttcctgcacatccttgccaaatcgctgagccagcacttccctgaactcctgggctttgctcaggacctgcccaccgtgcccctggctgccaaagtgaaccaacgggccctgaccagtgacctggctgacctccatggcactatcagcgagatacaggatgcctgccagagcatttccccctctagcgaggacaagtttgcaatggtcatgtcgtccttcctggagacggcccagccagcacttcgggcgctcgacgggctgcagcgcgaggccatggaggagctgggcaaggcgctggccttctttggggaggattccaaggccaccacctctgaggctttcttcggcatctttgcagagttcatgagcaaattcgagcgagcgctgagtgacctgcaggccggggagggcctgcgcagctccgggatggtttcacccctggcctggtgacagtggccacaccgcgtcctctgcggcctgagcagggagatggaggc

SEQ ID NO: 137466 - DNA, 2637 bp, Homo sapiens
  Payload ID: 6912
  Gene Symbol: GRIK1
  Gene Name: glutamate receptor, ionotropic, kainate 1
  ENST ID: ENST00000309434
  CDS Start-End: 1-2637
ggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaaggctgctggcgaagtgtctaaacacttgtataaagtgtggaagaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacaggctttttgtttcttttatggactgcaatgtaagcaaacccatccaaccaactccacttctggaactactttatctacggatttagaatgtggtaaattaattcgagaggagagagggattcgaaaacagtcctcagttcatactgtg

SEQ ID NO: 137467 - DNA, 3179 bp, Homo sapiens
  Payload ID: 6912
  Gene Symbol: GRIK1
  Gene Name: glutamate receptor, ionotropic, kainate 1
  ENST ID: ENST00000327783
  CDS Start-End: 33-2882
tgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaaggctgctggcgaagtgtctaaacacttgtataaagtgtggaagaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagaaaggaaagtcatcaagaattagattttattttaggaacaaagtaaggtttcatgggagaaaaaaacaaagccttggtgtagagaagtgtctctctttcaacgctatcatggaagaactgggaatctcactgaagaatcagaaaaaaataaagaaaaagtcaagaactaaggggaaatcttccttcacaagtatccttacttgtcatcagagacgaactcagagaaaagagactgtggcgtgatccaaggaaacgcctgtaggaagaaaaaggatgcattccctacagatttttggagaaaggatttctgaggagtgtgtgatgtgtttccatatatctatatccataactctgattatgaatacagatataagaaatacaaaagtttaaaaagctcacatagatatgacttgggaagtgacaccagttcttttaaaataaatttgtatgctcaattattttgcattttttctttttccccaataaattgttgtgtgtgctttctaaataataataaaacaacagggtttttttccagaa

SEQ ID NO: 137468 - DNA, 2712 bp, Homo sapiens
  Payload ID: 6912
  Gene Symbol: GRIK1
  Gene Name: glutamate receptor, ionotropic, kainate 1
  ENST ID: ENST00000389124
  CDS Start-End: 33-2648
tgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaaggctgctggcgaagtgtctaaacacttgtataaagtgtggaagaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagcattactgaagtgtccgtatgccttgataatcctatcaatgtttggatcatctcagtgggggaaatgacttaa

SEQ ID NO: 137469 - DNA, 3140 bp, Homo sapiens
  Payload ID: 6912
  Gene Symbol: GRIK1
  Gene Name: glutamate receptor, ionotropic, kainate 1
  Uniprot ID: P39086
  ENST ID: ENST00000389125
  CDS Start-End: 126-2843
agcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagtgtctctctttcaacgctatcatggaagaactgggaatctcactgaagaatcagaaaaaaataaagaaaaagtcaagaactaaggggaaatcttccttcacaagtatccttacttgtcatcagagacgaactcagagaaaagagactgtggcgtgatccaaggaaacgcctgtaggaagaaaaaggatgcattccctacagatttttggagaaaggatttctgaggagtgtgtgatgtgtttccatatatctatatccataactctgattatgaatacagatataagaaatacaaaagtttaaaaagctcacatagatatgacttgggaagtgacaccagttcttttaaaataaatttgtatgctcaattattttgcattttttctttttccccaataaattgttgtgtgtgctttctaaataataataaaacaacagggtttttttccagaa

SEQ ID NO: 137470 - DNA, 3472 bp, Homo sapiens
  Payload ID: 6912
  Gene Symbol: GRIK1
  Gene Name: glutamate receptor, ionotropic, kainate 1
  Uniprot ID: P39086
  ENST ID: ENST00000399907
  CDS Start-End: 413-3169
ctttcccccttttccctcctctgtctgtgcctatcccccgacttttgcatctgaccaaaggacgaatgagggagacgttcctgcagatcggggcagcaactttcctcagctggtctctgggctccgggagccagagagcgctgatcctccgcggtctgcggcccatggaagaggaggaggaggagccgtgatgggctagcgacagcactgaggagccccgagagagctcagccttgccagccagctccgcggtcccacgcgggttccctcgagctcgctccgtggggagcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaaggctgctggcgaagtgtctaaacacttgtataaagtgtggaagaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacaggctttttgtttcttttatggactgcaatgtaagcaaacccatccaaccaactccacttctggaactactttatctacggatttagaatgtggtaaattaattcgagaggagagagggattcgaaaacagtcctcagttcatactgtgtaatcagtttaaaaaaaaaaaaaaagatgtgcccagtagaaaatgtttttgctaattggtgttgttgatatttgtatttgctaagcataaatagccacaattctctattcctttaggatagcaaaactcatgtattctagacattgaaatgaatacactggaaagatacttgcactgtatgttgaagcaggggcatattaggggtataaagacttctagaaatgtgtatttacaggaatcttctctgtcccactcatcatcttagttctatcttcatgcattaaaaataagtaactcttccttcat

SEQ ID NO: 137471 - DNA, 3427 bp, Homo sapiens
  Payload ID: 6912
  Gene Symbol: GRIK1
  Gene Name: glutamate receptor, ionotropic, kainate 1
  ENST ID: ENST00000399909
  CDS Start-End: 413-3124
ctttcccccttttccctcctctgtctgtgcctatcccccgacttttgcatctgaccaaaggacgaatgagggagacgttcctgcagatcggggcagcaactttcctcagctggtctctgggctccgggagccagagagcgctgatcctccgcggtctgcggcccatggaagaggaggaggaggagccgtgatgggctagcgacagcactgaggagccccgagagagctcagccttgccagccagctccgcggtcccacgcgggttccctcgagctcgctccgtggggagcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacaggctttttgtttcttttatggactgcaatgtaagcaaacccatccaaccaactccacttctggaactactttatctacggatttagaatgtggtaaattaattcgagaggagagagggattcgaaaacagtcctcagttcatactgtgtaatcagtttaaaaaaaaaaaaaaagatgtgcccagtagaaaatgtttttgctaattggtgttgttgatatttgtatttgctaagcataaatagccacaattctctattcctttaggatagcaaaactcatgtattctagacattgaaatgaatacactggaaagatacttgcactgtatgttgaagcaggggcatattaggggtataaagacttctagaaatgtgtatttacaggaatcttctctgtcccactcatcatcttagttctatcttcatgcattaaaaataagtaactcttccttcat

SEQ ID NO: 137472 - DNA, 3234 bp, Homo sapiens
  Payload ID: 6912
  Gene Symbol: GRIK1
  Gene Name: glutamate receptor, ionotropic, kainate 1
  ENST ID: ENST00000399913
  CDS Start-End: 175-2937
agccagctccgcggtcccacgcgggttccctcgagctcgctccgtggggagcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaaggctgctggcgaagtgtctaaacacttgtataaagtgtggaagaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagtgtctctctttcaacgctatcatggaagaactgggaatctcactgaagaatcagaaaaaaataaagaaaaagtcaagaactaaggggaaatcttccttcacaagtatccttacttgtcatcagagacgaactcagagaaaagagactgtggcgtgatccaaggaaacgcctgtaggaagaaaaaggatgcattccctacagatttttggagaaaggatttctgaggagtgtgtgatgtgtttccatatatctatatccataactctgattatgaatacagatataagaaatacaaaagtttaaaaagctcacatagatatgacttgggaagtgacaccagttcttttaaaataaatttgtatgctcaattattttgcattttttctttttccccaataaattgttgtgtgtgctttctaaataataataaaacaacagggtttttttccagaa

SEQ ID NO: 137473 - DNA, 3624 bp, Homo sapiens
  Payload ID: 6912
  Gene Symbol: GRIK1
  Gene Name: glutamate receptor, ionotropic, kainate 1
  ENST ID: ENST00000399914
  CDS Start-End: 523-3327
agaagccggaacgtggctccgctcccagttaacctgctggagctcatcaggcttgctcagagcccctgcaccaactcaccctgtaccctctctccttcttcgttagtcttctttcccccttttccctcctctgtctgtgcctatcccccgacttttgcatctgaccaaaggacgaatgagggagacgttcctgcagatcggggcagcaactttcctcagctggtctctgggctccgggagccagagagcgctgatcctccgcggtctgcggcccatggaagaggaggaggaggagccgtgatgggctagcgacagcactgaggagccccgagagagctcagccttgccagccagctccgcggtcccacgcgggttccctcgagctcgctccgtggggagcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagaaaggaaagtcatcaagaattagattttattttaggaacaaagtaaggtttcatgggagaaaaaaacaaagccttggtgtagagaagtgtctctctttcaacgctatcatggaagaactgggaatctcactgaagaatcagaaaaaaataaagaaaaagtcaagaactaaggggaaatcttccttcacaagtatccttacttgtcatcagagacgaactcagagaaaagagactgtggcgtgatccaaggaaacgcctgtaggaagaaaaaggatgcattccctacagatttttggagaaaggatttctgaggagtgtgtgatgtgtttccatatatctatatccataactctgattatgaatacagatataagaaatacaaaagtttaaaaagctcacatagatatgacttgggaagtgacaccagttcttttaaaataaatttgtatgctcaattattttgcattttttctttttccccaataaattgttgtgtgtgctttctaaataataataaaacaacagggtttttttccagaa

SEQ ID NO: 137474 - DNA, 2896 bp, Homo sapiens
  Payload ID: 6912
  Gene Symbol: GRIK1
  Gene Name: glutamate receptor, ionotropic, kainate 1
  ENST ID: ENST00000535441
  CDS Start-End: 1-2601
ggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagtgtctctctttcaacgctatcatggaagaactgggaatctcactgaagaatcagaaaaaaataaagaaaaagtcaagaactaaggggaaatcttccttcacaagtatccttacttgtcatcagagacgaactcagagaaaagagactgtggcgtgatccaaggaaacgcctgtaggaagaaaaaggatgcattccctacagatttttggagaaaggatttctgaggagtgtgtgatgtgtttccatatatctatatccataactctgattatgaatacagatataagaaatacaaaagtttaaaaagctcacatagatatgacttgggaagtgacaccagttcttttaaaataaatttgtatgctcaattattttgcattttttctttttccccaataaattgttgtgtgtgctttctaaataataataaaacaacagggtttttttccag

SEQ ID NO: 137475 - DNA, 4317 bp, Homo sapiens
  Payload ID: 6913
  Gene Symbol: GRIK2
  Gene Name: glutamate receptor, ionotropic, kainate 2
  ENST ID: ENST00000318991
  CDS Start-End: 1-2565
ggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaagagagccaagactaagttacctcaagactatgtattcctccctattttggagtcagtttccatttctacagtgttgtcatcatcaccatcttcatcatcattatcatcatgttcttaataagtacatctaataaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttca

SEQ ID NO: 137476 - DNA, 1981 bp, Homo sapiens
  Payload ID: 6913
  Gene Symbol: GRIK2
  Gene Name: glutamate receptor, ionotropic, kainate 2
  ENST ID: ENST00000358361
  CDS Start-End: 486-1547
gcagctatctcagtctttctcacttaatcttggcttcacgtcagaagctgtgcagcagtgcagtagaatagggcctggcaaaacctttgctagcaaagcgccttttgtgccgggctgtggctcgctatcgacatctcgtccgttaccaaggctgggtttcctactgatttccctcctcctctgctttcacaggctcgcgcggccggacattgtgggtgtgcgtgctggatttctcccggatgctctccgactaacatggatgtcccaccattccttgcagtggaaggttgttccttggcgcagtgagtgaagaacatgcagcgattgctaatgggtttgggaagcggagactccttcctctctctatgaccatgccgtgatcgtgtctgcggtcaccactcgacgcatcctcatttctacccgaacccaggagccgaacgctagatcggggaagtgggtgccgtgcgtgtgggcacagaaacaccatgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgatggagtttcactcttgttgcccaggctggagtgcaatggcacgatctcagctcactgcaacctctgcctcctgggttcaagcgattcttctgcctcagcctcccgagtagctgagattacaggcacacaccactatgcctggctaatttttttgtatttttagtagagatggggtttctctatgttggtcaggatggtctcgaactcctgacctcaggtaatccgcccaccttggcctcccaaagtgctgggattacaggcaagagccactgcacctggcccacagtttcttaatccatttgttgattgatgggcatatgggctggttccatatgtttgcaactgcaaattgtgagcactgtttaattctaagcttccttgtaggtaaggcaaaaagcaagcaaagtattttaggcaattcccataactaaagggaaattatttattatatttgtccatttgaaaagatattttttcatgttgtaaaaaatttattaaatgaatgctaacataaggattaataaacaacatgatcttaacattc

SEQ ID NO: 137477 - DNA, 4185 bp, Homo sapiens
  Payload ID: 6913
  Gene Symbol: GRIK2
  Gene Name: glutamate receptor, ionotropic, kainate 2
  ENST ID: ENST00000369134
  CDS Start-End: 1-2613
ggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaagaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttca

SEQ ID NO: 137478 - DNA, 4272 bp, Homo sapiens
  Payload ID: 6913
  Gene Symbol: GRIK2
  Gene Name: glutamate receptor, ionotropic, kainate 2
  ENST ID: ENST00000369137
  CDS Start-End: 1-2496
ggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaaggaatcttctatttggttagtgccaccataccatccagacactgtttagtaatcttttgaaacttactaaaagaggtttttaataatgaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttca

SEQ ID NO: 137479 - DNA, 4921 bp, Homo sapiens
  Payload ID: 6913
  Gene Symbol: GRIK2
  Gene Name: glutamate receptor, ionotropic, kainate 2
  Uniprot ID: Q13002
  ENST ID: ENST00000369138
  CDS Start-End: 491-3169
ggagagcagctatctcagtctttctcacttaatcttggcttcacgtcagaagctgtgcagcagtgcagtagaatagggcctggcaaaacctttgctagcaaagcgccttttgtgccgggctgtggctcgctatcgacatctcgtccgttaccaaggctgggtttcctactgatttccctcctcctctgctttcacaggctcgcgcggccggacattgtgggtgtgcgtgctggatttctcccggatgctctccgactaacatggatgtcccaccattccttgcagtggaaggttgttccttggcgcagtgagtgaagaacatgcagcgattgctaatgggtttgggaagcggagactccttcctctctctatgaccatgccgtgatcgtgtctgcggtcaccactcgacgcatcctcatttctacccgaacccaggagccgaacgctagatcggggaagtgggtgccgtgcgtgtgggcacagaaacaccatgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaagagagccaagactaagttacctcaagactatgtattcctccctattttggagtcagtttccatttctacagtgttgtcatcatcaccatcttcatcatcattatcatcatgttcttaataagtacatctaataaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttca

SEQ ID NO: 137480 - DNA, 540 bp, Homo sapiens
  Payload ID: 6913
  Gene Symbol: GRIK2
  Gene Name: glutamate receptor, ionotropic, kainate 2
  ENST ID: ENST00000455610
  CDS Start-End: 1-540
tgtagccatgaaatggcagcaggcattttaaaacaggcattagctatgggaatgatgacagaatactatcattatatctttaccactctgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctc

SEQ ID NO: 137481 - DNA, 4789 bp, Homo sapiens
  Payload ID: 6913
  Gene Symbol: GRIK2
  Gene Name: glutamate receptor, ionotropic, kainate 2
  Uniprot ID: Q13002
  ENST ID: ENST00000421544
  CDS Start-End: 491-3217
ggagagcagctatctcagtctttctcacttaatcttggcttcacgtcagaagctgtgcagcagtgcagtagaatagggcctggcaaaacctttgctagcaaagcgccttttgtgccgggctgtggctcgctatcgacatctcgtccgttaccaaggctgggtttcctactgatttccctcctcctctgctttcacaggctcgcgcggccggacattgtgggtgtgcgtgctggatttctcccggatgctctccgactaacatggatgtcccaccattccttgcagtggaaggttgttccttggcgcagtgagtgaagaacatgcagcgattgctaatgggtttgggaagcggagactccttcctctctctatgaccatgccgtgatcgtgtctgcggtcaccactcgacgcatcctcatttctacccgaacccaggagccgaacgctagatcggggaagtgggtgccgtgcgtgtgggcacagaaacaccatgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaagaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttca

SEQ ID NO: 137482 - DNA, 4876 bp, Homo sapiens
  Payload ID: 6913
  Gene Symbol: GRIK2
  Gene Name: glutamate receptor, ionotropic, kainate 2
  Uniprot ID: Q13002
  ENST ID: ENST00000413795
  CDS Start-End: 491-3100
ggagagcagctatctcagtctttctcacttaatcttggcttcacgtcagaagctgtgcagcagtgcagtagaatagggcctggcaaaacctttgctagcaaagcgccttttgtgccgggctgtggctcgctatcgacatctcgtccgttaccaaggctgggtttcctactgatttccctcctcctctgctttcacaggctcgcgcggccggacattgtgggtgtgcgtgctggatttctcccggatgctctccgactaacatggatgtcccaccattccttgcagtggaaggttgttccttggcgcagtgagtgaagaacatgcagcgattgctaatgggtttgggaagcggagactccttcctctctctatgaccatgccgtgatcgtgtctgcggtcaccactcgacgcatcctcatttctacccgaacccaggagccgaacgctagatcggggaagtgggtgccgtgcgtgtgggcacagaaacaccatgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaaggaatcttctatttggttagtgccaccataccatccagacactgtttagtaatcttttgaaacttactaaaagaggtttttaataatgaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttca

SEQ ID NO: 137483 - DNA, 1066 bp, Homo sapiens
  Payload ID: 6913
  Gene Symbol: GRIK2
  Gene Name: glutamate receptor, ionotropic, kainate 2
  ENST ID: ENST00000436862
  CDS Start-End: 1-549
attggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtaacatgctcacttttgtgatttttttggcaattgttacctcctttatctaactaataattgtcaaaagtcacaatcaattttactttttctgttctttattttccatggggtgctgagaaataatgaaattttaagaatcacattcatttattaaaatgtactgtcctgtctttgtgggcagagagcatgctggttgtgtcagtaagctataagtgttatagggattactgttttcttaaccagaatataaaagctttttaaatcaatatgataaatgaatcattgcctcacttcgaagatttctgaagaaccaaaactaaaataacatgttttactaacttgagttaataattcagttataagaaaaaccaaagtactaaaatttaaaaggaggccttttttaaggaaccaagacatttataataaacattctaactataaaaggactaccttagtattctacataatatttgtggtttttttcttgttttttcacagaataaatgtcattaccaaaa

SEQ ID NO: 137484 - DNA, 9101 bp, Homo sapiens
  Payload ID: 6914
  Gene Symbol: GRIK3
  Gene Name: glutamate receptor, ionotropic, kainate 3
  Uniprot ID: Q13003
  ENST ID: ENST00000373091
  CDS Start-End: 18-2777
ctcggcggcgcccaacgatgaccgctccctggcggcgcctccggagtctggtttgggaatactgggccgggctcctcgtgtgcgccttctggatcccggactcgcgcgggatgccccacgtcatccggatcggaggaatcttcgagtatgcggacggccccaacgcccaggtcatgaatgccgaggagcatgcctttcgattttctgccaacatcatcaacaggaacaggactctgctgcccaacacaaccttgacctatgacatacagaggattcacttccatgacagcttcgaggcgaccaaaaaggcctgtgaccagctggcactgggcgtggtggcgatcttcggcccatcacagggctcctgcaccaatgccgtccagtccatctgcaatgccctggaggtgccccacatccagctgcgttggaagcaccacccgctggacaacaaggacaccttctacgtgaacctctaccccgactacgcctcgctcagccatgccatcctcgacctggtccagtacctcaagtggcggtcagccaccgtggtctatgacgacagtacagggctcatccgactgcaggagctcatcatggccccatcaagatacaacatccgcctgaagatccgtcagctccccatcgactctgacgactcgcgccccttgctcaaggagatgaagcgaggccgggaattccgcattatcttcgactgcagccacactatggcggcccagatcctcaagcaggccatggccatgggcatgatgactgagtactaccacttcatcttcaccactctggatctctacgctttagacctggagccctaccgctactcaggcgtgaacctgacaggattccggattctcaatgtggacaacccacacgtctcggccattgtggagaagtggtccatggagcggctgcaggcagctccccggtccgagtctggcctgctggatggagtgatgatgactgatgcagccttactgtacgacgccgtccatatcgtgtccgtgtgctaccagcgggcaccacagatgaccgtgaactccctgcagtgccatcggcacaaggcctggcgctttggcggccgcttcatgaacttcatcaaggaggctcaatgggaaggattaactggacgaattgttttcaacaaaactagtggcttgcggacggattttgatctggacatcatcagcctgaaagaggatggcctggagaaggttggggtgtggagtcctgccgacgggctcaacatcactgaggttgccaaaggccgaggccctaatgtcaccgactctctgacaaacagatcactcattgtcaccacagtgctggaggagcccttcgtcatgtttcggaaatcagacaggacgctatacgggaatgaccggttcgagggctactgcatcgacctgctaaaggagctggcccacatccttggtttctcctatgagatccggctggtggaggacggcaagtacggggcacaggatgacaagggccagtggaacggcatggtcaaggagctcatcgaccacaaggcagatctggccgtggcccccctgaccatcacccatgttcgagagaaggccatcgacttctccaagcccttcatgacacttggtgtgagcatcctgtatcgaaagcccaatggcaccaaccccagcgtcttctccttcctcaatcccctgtccccagacatctggatgtatgttctcctcgcctacctgggggtcagctgtgtcctcttcgtcatcgccaggttcagcccttatgagtggtacgatgctcacccctgcaaccctggctccgaggtggtggaaaataacttcactctgcttaacagcttctggtttggaatgggatccctgatgcagcaagggtctgagctgatgcccaaagccctgtccacacgcatcattggtggcatctggtggttcttcacgctcatcatcatctcttcctacacggccaacctggctgcctttctgaccgtggagcgcatggaatcacccattgactctgctgatgacctggccaagcaaaccaaaatcgagtatggggctgtcaaggatggggccaccatgaccttcttcaagaaatccaagatctccaccttcgagaagatgtgggccttcatgagcagcaagccatcggcgctggtgaagaacaacgaggagggcatccagagggccctgacggccgactacgcgctgctcatggagtccaccaccatcgagtacgtcacgcagaggaactgcaacctcacccagatcgggggcctcattgactccaagggctacggcatcggcacgcccatgggctccccataccgggacaagatcaccatcgccatcctgcagcttcaggaggaggacaagctgcatatcatgaaggagaagtggtggcggggcagcgggtgtcctgaggaggaaaacaaagaggccagtgccctggggatccagaagatcgggggcatcttcattgtcctggccgccgggctggtcctctctgtgctggtggccgtgggcgagtttgtgtacaagctccgcaaaacagcagagagagagcagcgttccttctgcagcaccgtggccgatgagatccgtttctcccttacctgccagcgtcgagtcaagcacaagcctcagcctcccatgatggtcaagactgacgccgtcatcaacatgcacacattcaatgaccgccggcttcccggcaaggacagcatggcctgcagcacatccttagcccctgtgttcccctaggcacagctggggtggggacctcaggcctgggggctgggcagaggaaagcaaaggagattggaaggaacgtcccctgtccccgcactgggcttggggaccagagctgccacctgcctgttgggccaggagcctcctgcccttacctgccaggaagccagcaggctctcaggccagctgcttgggcttcatcctcctcagatcttctgtgggtttctaaagctgccagccgagatagccaaggccaaaggaagcacatgcctctctcaggccaaactcacctgcccctcaactctcctccagagtcagaagtttctgccgcagccctgcagagggcacagaaaatggaagacagctcttatattgccatttcttccacaagagcccaggcctcctacagcttgaccgtgaggccagagacacaagccttcggcgccttaaggatgttctagcatggctgccaatgggagctcatggtgagggatacccatcccatatgcctgggcagaaggaagacttcatccctctggggctgttcacgtggtcctaatcttctgaacttggcgctgcccctggcagcccctgttctggcagagttgaagacagagctacacaggggaaaagaggagtttggggtatgggagagaagagaatgcacaaacagaggccgccattttggattcttatggacaatgacccagtggttcctaatcctctaggaggtctctaagaatataagtgggggagtggccacagaaaattcttctccactttctagccagaggagagaggaccccctgaatttctcacaaaggatgcccaaagatgcagccggtatttgaagcccagcagaggaaaagcagattccatggaagtcccaccggctcttgtgccaatggatctcactttcctggttagcaagctgttgtctaaaccctgttcacatttggaaacctgggctctttgccatcttctcatcaacaactccccattcctggctggttgaccttggcctcactctgtctttttgaaagaagagttggttgaagtgaaagtcaagttgtccctcctcaaaaaaggagttagtgtcctactacacagactaactttgggctaggtgagggaaaccagaagagaccaaaagaacttctggtctcctggacttaccaaacctagagatgctccccaggaaaagaaagtttccagggacataatatcatagctggcagaggccccaagggtggggaggaagaagctgcctcctggagaattaaccaaagaccccacacagagacatgaggccatcctggccccttgtctgttgtccagagcagctatggcattgtggggcttggggaagacagcagagaagtagcagcaggttgggtaccagccagggggtggacctatgagttccagcttgctgtgatgaatgctctagaggtctgtgactttaagagtcttggaaaagaatgagacatgaaggattaggaacaaagtgtccttaaagagaacatgatgggccagcagggttaccatggccaaggatggaggggcaggttttgaacaggggagggaggttctggggattctggatgagaactggggcataccagccactcccctcccacctctgtcccatgctgcttgggaagcccggttagggaagagcttcatttggatctcaagggctttctcatctgggtgaagggcaatctctagcaaagcaggagaccacagtgggctcatgtgataaacactgtccctcctccagactgtgagctgcaggaccaaaccagcaggttcccagaatcctagcagctctgactggctatgtacattggacgagggagaggagggctagacatacaccaaagccccatgcatgtaatgttaggaaaagccatgctgtcataagcttcagggtacagagggcgtgtgcatgtgtgtctgtgtctttgtgtttgtatgtgtgagcttcgggggctggggcacaggacagatctggacatataacatagtccagggcatgcaataataggtgaatccttggggatctgatgtgtgcatatgcgtgcgtatgtgtatctgagtgaattggggacgagggagacaaatatgtgaagcagcaaggccccatatatgtaaaaacaggagaagccatgtcataatggggccctggtgggtatgcatatgtaagcatgcatgcatgcataggtgtgtgcatgctggtgtgtgtgtgtgcacatgtacactgaatggcataggatggagatcaggatcttacctgcagctagccaaatatgcgtaaaaggagaagccatgtcaccaaggggtccatgtctgagtgcatgtgaacacatgtgtacaggcatgtgtgcacagtggggagcggggggaaggccaggaccagagagtcgtgtgacatgggtcaatgcatgctgtagacaagaagccacgtggagttgaagtttccgagtgtgtgggacacacacatatgttccaggtcacagtggaagcaaagacagacaatcaggaaggccgggcaccagggtctgtttgcacttctgtcatgggagagatcatttgtcacagagaggttccaaggttgcatgggcacacttgccaggagacgggggcacaacccttcaggggctcatgctgctgatgcctttgctgtggacatcatgtcctgtttgaagggaaaactcttttttgtaattcccaggtaacaggattctaatgaaggtatttgccaatttgctgtcagcaaacacaatcattaagcgccgtcttactttgtccagtatagtttcagagcacgtgcctcattcttgctcttgtctcacacatgtgttgtgtgtgtgatgctacatgagcatgttcttcagaggctatgcatatatgtggattgtgacaggaggaagaagaagtggtgagaatttttataaaacgaacaaagaatagtggataaatagaggcagaattcaattcgagaaaccccccaaaatgtaccgactggtctttagactcctgtgtggaagcaggagggcatgctgcctcatctcctctcccaggcaaaccttgcgtcctgatgttcaggtgttgtcggtgtggctgatatttggcttctggccaatatcctgcatttgtcctagagaccagcctagtgttcaaagtgcagtggggaccacagctgcccaagcatgagctctgtctctcccggggcactgaaaatgatgctacatctgtgaggtgggacggagtggggaggtgttttcagtgaggcagatcttgtgtttttttaagtttaggtctgtcctgccagtgggcatggagctgagctggggcaggtgcatgcgtgtgtgtgtatgtgtgtgtatgcatgtgtagtgtgtgtgcacacacgcaggcactgagaggtgatgggaagcatgaaagcttgcttggatggagcagaagaaggaacctgcctgagcagatgctggactgtccctgcgtggtgccacatgccagccctgaacagaagaatgtccccactgcatccccaaatgcaagtgcctcctctccacctgctcaagctggccaagttgaggggcagtggtaagaagacaccaaccccaccgcccctgccgaggccctgggactaaggacagtgagccctcccaatcactctccccttgtcctgctgctggtttctctgctctggacagaagaaaatcctgaaagcgttgtcaatgttcaagtggccccatgctgcaagagtctctcgcgaggggtgacgcccccttggccagtgtgctggactttgagtgtctgaggggtaagagggccaccccctcctcacagccgagactctatctaacctggaagcacactctggctccacccccaacccctgccatgccctaggccctggaagatgggaatcctggcccaggccagggtaaagggccaaacaggttagaagttgctcccctccaccaggcgtgcactcaccaagaacgatcaaaagctccctttctgcctacttttccaggggtactgggtgtggggggtgggtcacagctcctgcttcatcactcagcatgaagttggtccctccctgagccactcccagctacatgcacaaacatctgaaagtaggctggcctctctggctcacatctggagtggtcctgtgtggatacccatctgcaaaggggctagaggtttggacaaacagctgcatggacttatcatctgggatgggcccagcctcatggacagatacaagaaatgagcccaactctgtgggcaggtctctggattagacacatctgaaagttgcaggtcaagtggacacatctggaagtggcccggctgctggctgccatggaagggccgtgccctctgtccccatggcagtttaaatcaggccttcccttcagtcctggatttgccctggagtaaaaatttcagagctgaggtcatacgtgagtcacaaaacttttaggtagaaggttaatgttctgtacaatatatatatgaatgtaaaatatatatatatactgtatatatatatatatatgcacagtgtatatatgacctgtagcccatgtgtatacaaccctttcctgcacgtctgcacacggagtgtacagaacccagccagcacgggtgaggaccagatgagagatgggggctgcagcagcaaagtctgggacggaggtctcagagagccccttggggtggcgaaggccctccacacatcagagctccagaccctgaagaagagggcagagctacatggtgctgccaggtgagtcctgcaccgccagggcctcctgtgggaggggcaggaatggccaacggacctcatctccatccgagcctgtctgaggcaggacagctgggtgtgtctgagaagcaatgtcatgctagtactcagcccctgtgccaatattacattctagttctggggcaattcatcaggagcagaagggctgggaaagagcaggccactccccaggcctgttctcacacctgcctgcagaatcacaggtaggtttcaggctccatctaggataccctagaaggcggggctattctaggtagcaaaagcctctgcctctgattctcacccacatgcagaagcagtcacaacttgcacacaacacagctcacaactagggaaagcacttgttaaagagaatgcccccagggcatggccagcatgccgatacagtgttcccatgcccctgttactgatcctgtcctcctgccttctagaacagtggacctcacatcacctcccagattgtctccattttatggattgaaactctgaggcctccagacatgaagaagcagccatagattcagtcaaatgccagccaagggtttgccttgcctcagacaacctccccagccccatttgacccagagaccagctgtcagggagcgacctcagagccagaggggtgaaagatgagaggcaagaaggtagctcctatcctagcacagcccaggctccatctgtctgcctttctctcccctgcggcatcctggcagggcagttggcagagtgccccctccccaggaggctgcagatctctgtccctggctcacccagatcggtctgttctctgcagttccattcctttagcctctttcgcaggtctgagcatctctggagcatgcaggggaggagatatctgaggtgggcttccgtgcagtcagcagcctgccccagcttcagcctcaggcgtcaggctggtctgcactgaactctgggtctgcctctggggccctgaccaagcacgcctgactccagccccatgaggagcatcctgtcttggttccgtagggatcatgggtcctcttaccactgtgcgccaagcccccagcccacctctgcctgggccgacttcctggttgggcctcccatggtaggggcctcagttcccaggctctgggctgagcccccagggagcaccatgggcctctgagaccctagacctgtcccaccacccagaccagagtgcctggacgccccccactcccactcaacatggttcccacacactggtctctgggccattcaggggatgccctttgtggacatgcagaatttctatgaatatagttttttgtaaacattttgtaacaatttgggtttcatagtaactgtgttacttgccaatcattctaggctgatgtaaataaatttccaaacaaatctgattattttcctttttaagacactgtgatatatcaaagtgcacagtttgctgtatgaagtaatatggttttaaattttaaataaaatgtttctagaaaacaggg

SEQ ID NO: 137485 - DNA, 2955 bp, Homo sapiens
  Payload ID: 6914
  Gene Symbol: GRIK3
  Gene Name: glutamate receptor, ionotropic, kainate 3
  Uniprot ID: Q13003
  ENST ID: ENST00000373093
  CDS Start-End: 22-2640
cacgctcggcggcgcccaacgatgaccgctccctggcggcgcctccggagtctggtttgggaatactgggccgggctcctcgtgtgcgccttctggatcccggactcgcgcgggatgccccacgtcatccggatcggaggaatcttcgagtatgcggacggccccaacgcccaggtcatgaatgccgaggagcatgcctttcgattttctgccaacatcatcaacaggaacaggactctgctgcccaacacaaccttgacctatgacatacagaggattcacttccatgacagcttcgaggcgaccaaaaaggcctgtgaccagctggcactgggcgtggtggcgatcttcggcccatcacagggctcctgcaccaatgccgtccagtccatctgcaatgccctggaggtgccccacatccagctgcgttggaagcaccacccgctggacaacaaggacaccttctacgtgaacctctaccccgactacgcctcgctcagccatgccatcctcgacctggtccagtacctcaagtggcggtcagccaccgtggtctatgacgacagtacagggctcatccgactgcaggagctcatcatggccccatcaagatacaacatccgcctgaagatccgtcagctccccatcgactctgacgactcgcgccccttgctcaaggagatgaagcgaggccgggaattccgcattatcttcgactgcagccacactatggcggcccagatcctcaagcaggccatggccatgggcatgatgactgagtactaccacttcatcttcaccactctggatctctacgctttagacctggagccctaccgctactcaggcgtgaacctgacaggattccggattctcaatgtggacaacccacacgtctcggccattgtggagaagtggtccatggagcggctgcaggcagctccccggtccgagtctggcctgctggatggagtgatgatgactgatgcagccttactgtacgacgccgtccatatcgtgtccgtgtgctaccagcgggcaccacagatgaccgtgaactccctgcagtgccatcggcacaaggcctggcgctttggcggccgcttcatgaacttcatcaaggaggctcaatgggaaggattaactggacgaattgttttcaacaaaactagtggcttgcggacggattttgatctggacatcatcagcctgaaagaggatggcctggagaaggttggggtgtggagtcctgccgacgggctcaacatcactgaggttgccaaaggccgaggccctaatgtcaccgactctctgacaaacagatcactcattgtcaccacagtgctggaggagcccttcgtcatgtttcggaaatcagacaggacgctatacgggaatgaccggttcgagggctactgcatcgacctgctaaaggagctggcccacatccttggtttctcctatgagatccggctggtggaggacggcaagtacggggcacaggatgacaagggccagtggaacggcatggtcaaggagctcatcgaccacaaggcagatctggccgtggcccccctgaccatcacccatgttcgagagaaggccatcgacttctccaagcccttcatgacacttggtgtgagcatcctgtatcgaaagcccaatggcaccaaccccagcgtcttctccttcctcaatcccctgtccccagacatctggatgtatgttctcctcgcctacctgggggtcagctgtgtcctcttcgtcatcgccaggttcagcccttatgagtggtacgatgctcacccctgcaaccctggctccgaggtggtggaaaataacttcactctgcttaacagcttctggtttggaatgggatccctgatgcagcaagggtctgagctgatgcccaaagccctgtccacacgcatcattggtggcatctggtggttcttcacgctcatcatcatctcttcctacacggccaacctggctgcctttctgaccgtggagcgcatggaatcacccattgactctgctgatgacctggccaagcaaaccaaaatcgagtatggggctgtcaaggatggggccaccatgaccttcttcaagaaatccaagatctccaccttcgagaagatgtgggccttcatgagcagcaagccatcggcgctggtgaagaacaacgaggagggcatccagagggccctgacggccgactacgcgctgctcatggagtccaccaccatcgagtacgtcacgcagaggaactgcaacctcacccagatcgggggcctcattgactccaagggctacggcatcggcacgcccatgggctccccataccgggacaagatcaccatcgccatcctgcagcttcaggaggaggacaagctgcatatcatgaaggagaagtggtggcggggcagcgggtgtcctgaggaggaaaacaaagaggccagtgccctggggatccagaagatcgggggcatcttcattgtcctggccgccgggctggtcctctctgtgctggtggccgtgggcgagtttgtgtacaagctccgcaaaacagcagagagagagcaggtaagccttagagcttggagcctgcacaggatgggaaatggagattcgcgctgatttcactcctgtatgtgccaggcacacagtggtgtctcatctcagcctcacaacagctcaccctgcatccagtcggccagcaagccctgccactctacctctgtcctgacctggcacttttttccatcgccgttgccccaccccaggccaagccccatcacctcctgcctggattatgccgcagccttcaaactggccctccagcctccatgcttccccaacaccatccacaattcacacagcaactggtaccttgtttaaaacttaattcaaaccatatcattttcctgcataaaaccctccagggtaattgtt

SEQ ID NO: 137486 - DNA, 4214 bp, Homo sapiens
  Payload ID: 6915
  Gene Symbol: GRIK4
  Gene Name: glutamate receptor, ionotropic, kainate 4
  Uniprot ID: Q16099
  ENST ID: ENST00000438375
  CDS Start-End: 343-3213
cctttcccgattccccgacgtttcgggaggagtggggtcggagcgcagggctgggaagggtcttaggacccaggaaggagacgggtgcctcccagagaggaccccatcccctccgaggtccgggcggctcccggcctctccctggggtgccgtagcccccctcgacccgccttcccgcagccgcagtcgttcgggcctggaggtggccgggcatcggtgccgacgccgcgagggcagcgcccgcggcgggaatactaatgcaccctaaagggcacggccgccgccgcagcagagttatgtcatgcccaggccagcagggggctccatgaggattcatagaagatgccccgcgtctcggcgcctttggtgctgcttcctgcgtggctcgtgatggtcgcctgcagcccgcactccttgaggatcgctgctatcttggacgaccccatggagtgcagcagaggggagcggctctccatcaccctggccaagaaccgcatcaaccgcgctcctgagaggctgggcaaggccaaggtcgaagtggacatctttgagcttctcagagacagcgagtacgagactgcagaaaccatgtgtcagatcctccccaagggggtggtcgctgtcctcggaccatcgtccagcccagcctccagctccatcatcagcaacatctgtggagagaaggaggtccctcacttcaaagtggccccagaggagttcgtcaagttccagttccagagattcacaaccctgaacctccaccccagcaacactgacatcagcgtggctgtagctgggatcctgaacttcttcaactgcaccaccgcctgcctcatctgtgccaaagcagaatgccttttaaacctagagaagctgctccggcaattccttatctccaaggacacgctgtccgtccgcatgctggatgacacccgggaccccaccccgctcctcaaggagatccgggacgacaagaccgccaccatcatcatccacgccaacgcctccatgtcccacaccatcctcctgaaggcagccgaacttgggatggtgtcagcctattacacatacatcttcactaatctggagttctcactccagagaatggacagccttgtggatgatcgtgtcaacatcctgggattttccattttcaaccaatcccatgctttcttccaagagtttgcccagagcctcaaccagtcctggcaggagaactgtgaccatgtgcccttcactgggcctgcgctctcctcggccctgctgtttgatgctgtctatgctgtggtgactgcggtgcaggaactgaaccggagccaagagatcggcgtgaagcccttgtcctgcggctcggcccagatctggcagcacggcaccagcctcatgaactacctgcgcatggtagaattggaaggtcttaccggccacattgaattcaacagcaaaggccagaggtccaactacgctttgaaaatcttacagttcacaaggaatggttttcggcagatcggccagtggcacgtggcagagggcctcagcatggacagccacctctatgcctccaacatctcggacactctcttcaacaccaccctggtcgtcaccaccatcctggagaacccatatttaatgctgaaggggaaccaccaggagatggaaggcaatgaccgctacgagggcttctgtgtggacatgctcaaggagctggcagagatcctccgattcaactacaagatccgcctggttggggatggcgtgtacggcgttcccgaggccaacggcacctggacgggaatggtcggggagctgatcgctaggaaagcagatctggctgtggcaggcctcaccattacagctgaacgggagaaggtgattgatttctctaagccattcatgactctgggaattagcattctttaccgcgttcatatgggacgcaaacccggctatttctccttcctggacccattttctccgggcgtctggctcttcatgcttctagcctatctggccgtcagctgtgtcctcttcctggtggctcggttgacgccctacgagtggtacagcccacacccatgtgcccagggccggtgcaacctcctggtgaaccagtactccctgggcaacagcctctggtttccggtcggggggttcatgcagcaaggctccaccatcgcccctcgcgccttatccacccgctgtgtcagtggcgtctggtgggcattcacgctgatcatcatctcatcctacacggccaacctggcagccttcctgaccgtgcagcgcatggatgtgcccattgagtcagtggatgacctggctgaccagaccgccattgaatatggcacaattcacggaggctccagcatgaccttcttccaaaattcccgctaccagacctaccaacgcatgtggaattacatgtattccaagcagcccagcgtgttcgtgaagagcacagaggagggaatcgccagggtgttgaattccaactacgccttcctcctggaatccaccatgaacgagtactatcggcagcgaaactgcaacctcactcagattgggggcctgctggacaccaagggctatgggattggcatgccagtcggctcggttttccgggacgagtttgatctggccattctccagctgcaggagaacaaccgcctggagatcctgaagcgcaaatggtgggaaggagggaagtgccccaaggaggaagatcacagagctaaaggcctgggaatggagaatattggtggaatctttgtggttcttatttgtggcttaatcgtggccatttttatggctatgttggagtttttatggactctcagacactcagaagcaactgaggtgtccgtctgccaggagatggtgaccgagctgcgcagcattatcctgtgtcaggacagtatccacccccgccggcggcgcgccgcagtcccgccgccccggccccccatccccgaggagcgccgaccgcggggcacggcgacgctcagcaacgggaagctgtgcggggcaggggagcccgaccagctcgcgcagagactggcgcaggaggccgccctggtggcccgcggctgcacgcacatccgcgtctgccccgagtgccgccgcttccagggcctgcgggcacggccgtcgcccgcccgcagcgaggagagcctggagtgggagaaaaccaccaacagcagcgagcccgagtagtcccggaggccacaggacgcgcagaggccgggcggggcgggaggggaggggcggggcgggcgctgctgtcagccgccagccggaacttgtacagcgtcgacacctctccagatttcggatccagtcacttttcaaaaagatcaaggagcctgacgccccagccagagaccgcgcccggtcagggagcagggtccacccggaaacgttgcacccaaagggcaaaggacggccctccctcctgggcacaaggacccatcttctcccagtgggtctttccctctcgccaaaataacaagagtatagggtggggggtccctacccagaccagtccaatgaattggtggaatcatcagttgaatttccccctagtcaggggccaatgtaccctccgtctagttcttacagaaaaaaaaaaaattaaacagggaagtttttcttttctggatttgtatatttttgttaatgttcttttcccttttctttcctcctctccttttcttctttgtcatcttctcagtcctgttaatttgttttgtgttttttggagggggaggctgggttagggaatggaagcctaaataatccctatttcttctttttcctgaattttggaatattgcgttaccagtgcatccgatttcaggtgcttaactctctgtatggtgactgaggggcctgcaggagcacaggagaaggagtcttgggaagaatcagatggagagtctcaaaagtccattgcagtaaactttgagatgccaaaaagcaattaactcatcctatactcagaccttgaaacgcctggaatgtcaagggttaatctgtcttttctttccctttctctttctgactgtcactattactgggtttgatttgatctttttgtgaatgtagtctctgaagacagacaggggaggagaacagaatgcacaaagtatcctaggactttgtttaaggagcggaaagagcagatagaattttcccataccatggccttggcttcc

SEQ ID NO: 137487 - DNA, 5802 bp, Homo sapiens
  Payload ID: 6915
  Gene Symbol: GRIK4
  Gene Name: glutamate receptor, ionotropic, kainate 4
  Uniprot ID: Q16099
  ENST ID: ENST00000527524
  CDS Start-End: 288-3158
agctgcgggcggatcgggctggagccgccacggctgctgcggaagaggaaaaacggccaacagcagccccgcggccggcccggcagcgcccggcccccggctcagcccccggagtgcggagccgaccagcagatactttctgagtgcctactatgtgccagcctgtgctaggcactgaggacacaggtggaaaagcccgaattgctccctgctctcctggcgctcatcaccccggagagttatgtcatgcccaggccagcagggggctccatgaggattcatagaagatgccccgcgtctcggcgcctttggtgctgcttcctgcgtggctcgtgatggtcgcctgcagcccgcactccttgaggatcgctgctatcttggacgaccccatggagtgcagcagaggggagcggctctccatcaccctggccaagaaccgcatcaaccgcgctcctgagaggctgggcaaggccaaggtcgaagtggacatctttgagcttctcagagacagcgagtacgagactgcagaaaccatgtgtcagatcctccccaagggggtggtcgctgtcctcggaccatcgtccagcccagcctccagctccatcatcagcaacatctgtggagagaaggaggtccctcacttcaaagtggccccagaggagttcgtcaagttccagttccagagattcacaaccctgaacctccaccccagcaacactgacatcagcgtggctgtagctgggatcctgaacttcttcaactgcaccaccgcctgcctcatctgtgccaaagcagaatgccttttaaacctagagaagctgctccggcaattccttatctccaaggacacgctgtccgtccgcatgctggatgacacccgggaccccaccccgctcctcaaggagatccgggacgacaagaccgccaccatcatcatccacgccaacgcctccatgtcccacaccatcctcctgaaggcagccgaacttgggatggtgtcagcctattacacatacatcttcactaatctggagttctcactccagagaatggacagccttgtggatgatcgtgtcaacatcctgggattttccattttcaaccaatcccatgctttcttccaagagtttgcccagagcctcaaccagtcctggcaggagaactgtgaccatgtgcccttcactgggcctgcgctctcctcggccctgctgtttgatgctgtctatgctgtggtgactgcggtgcaggaactgaaccggagccaagagatcggcgtgaagcccttgtcctgcggctcggcccagatctggcagcacggcaccagcctcatgaactacctgcgcatggtagaattggaaggtcttaccggccacattgaattcaacagcaaaggccagaggtccaactacgctttgaaaatcttacagttcacaaggaatggttttcggcagatcggccagtggcacgtggcagagggcctcagcatggacagccacctctatgcctccaacatctcggacactctcttcaacaccaccctggtcgtcaccaccatcctggagaacccatatttaatgctgaaggggaaccaccaggagatggaaggcaatgaccgctacgagggcttctgtgtggacatgctcaaggagctggcagagatcctccgattcaactacaagatccgcctggttggggatggcgtgtacggcgttcccgaggccaacggcacctggacgggaatggtcggggagctgatcgctaggaaagcagatctggctgtggcaggcctcaccattacagctgaacgggagaaggtgattgatttctctaagccattcatgactctgggaattagcattctttaccgcgttcatatgggacgcaaacccggctatttctccttcctggacccattttctccgggcgtctggctcttcatgcttctagcctatctggccgtcagctgtgtcctcttcctggtggctcggttgacgccctacgagtggtacagcccacacccatgtgcccagggccggtgcaacctcctggtgaaccagtactccctgggcaacagcctctggtttccggtcggggggttcatgcagcaaggctccaccatcgcccctcgcgccttatccacccgctgtgtcagtggcgtctggtgggcattcacgctgatcatcatctcatcctacacggccaacctggcagccttcctgaccgtgcagcgcatggatgtgcccattgagtcagtggatgacctggctgaccagaccgccattgaatatggcacaattcacggaggctccagcatgaccttcttccaaaattcccgctaccagacctaccaacgcatgtggaattacatgtattccaagcagcccagcgtgttcgtgaagagcacagaggagggaatcgccagggtgttgaattccaactacgccttcctcctggaatccaccatgaacgagtactatcggcagcgaaactgcaacctcactcagattgggggcctgctggacaccaagggctatgggattggcatgccagtcggctcggttttccgggacgagtttgatctggccattctccagctgcaggagaacaaccgcctggagatcctgaagcgcaaatggtgggaaggagggaagtgccccaaggaggaagatcacagagctaaaggcctgggaatggagaatattggtggaatctttgtggttcttatttgtggcttaatcgtggccatttttatggctatgttggagtttttatggactctcagacactcagaagcaactgaggtgtccgtctgccaggagatggtgaccgagctgcgcagcattatcctgtgtcaggacagtatccacccccgccggcggcgcgccgcagtcccgccgccccggccccccatccccgaggagcgccgaccgcggggcacggcgacgctcagcaacgggaagctgtgcggggcaggggagcccgaccagctcgcgcagagactggcgcaggaggccgccctggtggcccgcggctgcacgcacatccgcgtctgccccgagtgccgccgcttccagggcctgcgggcacggccgtcgcccgcccgcagcgaggagagcctggagtgggagaaaaccaccaacagcagcgagcccgagtagtcccggaggccacaggacgcgcagaggccgggcggggcgggaggggaggggcggggcgggcgctgctgtcagccgccagccggaacttgtacagcgtcgacacctctccagatttcggatccagtcacttttcaaaaagatcaaggagcctgacgccccagccagagaccgcgcccggtcagggagcagggtccacccggaaacgttgcacccaaagggcaaaggacggccctccctcctgggcacaaggacccatcttctcccagtgggtctttccctctcgccaaaataacaagagtatagggtggggggtccctacccagaccagtccaatgaattggtggaatcatcagttgaatttccccctagtcaggggccaatgtaccctccgtctagttcttacagaaaaaaaaaaaattaaacagggaagtttttcttttctggatttgtatatttttgttaatgttcttttcccttttctttcctcctctccttttcttctttgtcatcttctcagtcctgttaatttgttttgtgttttttggagggggaggctgggttagggaatggaagcctaaataatccctatttcttctttttcctgaattttggaatattgcgttaccagtgcatccgatttcaggtgcttaactctctgtatggtgactgaggggcctgcaggagcacaggagaaggagtcttgggaagaatcagatggagagtctcaaaagtccattgcagtaaactttgagatgccaaaaagcaattaactcatcctatactcagaccttgaaacgcctggaatgtcaagggttaatctgtcttttctttccctttctctttctgactgtcactattactgggtttgatttgatctttttgtgaatgtagtctctgaagacagacaggggaggagaacagaatgcacaaagtatcctaggactttgtttaaggagcggaaagagcagatagaattttcccataccatggccttggcttccggtggaacgtgccgttcacagaggcggaaggactgggccaccccgttggtatggtgcatactttgtcaactgcatctcttttcaaccaaactcaaatgagtggctgcctatgaagccagacccccaagactatcatggattgggtggtttcttgctacttagacgtgagacctgggtgcaagtgtatgtgtgtgtatgtgtgcgcgcgtgtgcgtgtgtgtatttattcaacagaaagaccttaagtattcaagaatttgctaggttcctgggagagaggtggagtctcctagtcaatacacgggcctgggaaccaggaactcttgagtcgtaacctcagcttgagcagtagccctcccaccttgtatgactttaggtaaagcatttaacttctcttccatctaccaaataggagttactgatgctgtccaggttaccaggtgactgctagtgactgctctccatgtgagaagtttgcagagtccagagcacacatctgatgggaggggcgaggctttctacagctgcttgacctttgcttggcttcactaattgggagtttcacgcagagttctcattggctgatggaaaacaaattctatgcaatttctgattgtaaacttagaaaattcagagagaaacaaacagccgctaccaaccacctccacctccaccaccgctgccaccaccttgaatggaattgtcctcacttttgttgctgttgcaaatgtactaaaataaagacatctttggaagatgacgagcttaattcatgtttttgccatttgggttggtcggcatcctctttatgccaggacaatcagttagggctgccgtcctgggggccaaatggtaccctgattattcctgtgagggatactcgttttgtcctcacctgacctcactcatgaatttgaatcctttatcttttttctctttaaccatcaaatgacaacaagctgtgcaagacacttgtgtctttttttaaaccttgccttgatcctcgtggagaaacgtggatttggtgggaagggcacccgaaggccagctgacaacaaaccccaatggtgccactctgctccaacctgcagctccatcctatgcttctcacagacaacgtggttcctactgtcagatcacatttggggcgggaagggtggttttttaaaaaaactcgtttttatgagcaggctatcttgatcaatagcaaactttttttaatggattagtgaaataaatgtccccatgcatcatttatagtctgtttctttctccgtgtggaatcaagataagactgccagcactagacggtttctgttagctgctgagaccagggcctcaccttgctcaagctagtgggtgaatttgcaaccagctaatactcttccttggtttgtttccactttttatctgttggttgttggctttcttttccattctgtattttctatctgactctgtatactgtataaagcagttttttcttgtctgtttatctttcttcaactggaatatttacaataaaacagaaacaaatcctgaaatgttagtgatggatgacagctgtttgggtttagaaagtatggttcagtgtgtctaatatccaggtactagacttgaaaagcaaataaaatcataaaccc

SEQ ID NO: 137488 - DNA, 3493 bp, Homo sapiens
  Payload ID: 6916
  Gene Symbol: GRIK5
  Gene Name: glutamate receptor, ionotropic, kainate 5
  Uniprot ID: Q16478
  ENST ID: ENST00000262895
  CDS Start-End: 1-2943
atgccggctgagctgctgctgctgctgattgttgccttcgccagccccagctgccaggtgctctcatcactgcgcatggctgcaatcctggatgatcagacagtgtgtggccgcggtgagcgtctggccttggccttggcccgggagcagatcaacgggatcatcgaggtcccagccaaggcccgagtggaagtagacatctttgagctgcagcgggacagccagtacgagaccacggacaccatgtgtcagatcttacccaaaggggttgtgtctgtccttgggccctcctctagcccagcatctgcctccaccgtgagccatatctgtggagagaaggagatcccccacatcaaggtgggtcccgaggagacaccccgccttcagtaccttcgcttcgcgtctgtcagcctgtaccccagtaacgaggacgtcagcttggcggtctcccgaatcctcaagtccttcaactacccctcggccagcctcatctgcgccaaggctgagtgcctgctgcgattggaggaactggtgcgtggcttcctcatctccaaggagacgctgtcagtgaggatgttggacgacagccgggaccccacaccactgctcaaggagatccgtgatgacaaggtgtccaccatcatcatcgacgccaacgcctccatctcccacctcatcctccgtaaggcctcggaactgggaatgacctcagcgttttacaagtacatcctcaccaccatggacttccccatcctgcatctggacggtattgtggaggactcctccaacatcctgggcttctccatgttcaacacgtcccaccccttctaccctgagtttgtccgcagcctcaacatgtcctggagggagaactgtgaagccagcacctacctgggccctgcgctgtcagccgccctgatgtttgacgccgtgcacgtggtggtgagcgctgtccgagagctgaaccgcagccaggagatcggtgtgaagcctctggcctgtacatcggccaacatttggccccacgggaccagcctcatgaactacctgcgcatggtagagtatgatgggctgaccgggcgggtcgagttcaacagcaaagggcagagaaccaactacaccctgcgcatcctagaaaagtcccggcagggccaccgtgagattggggtgtggtactctaaccgcaccctggccatgaatgccaccaccctggacatcaacctgtcgcagacactggccaacaagaccctggtggtcacaaccatcctggagaacccatacgtcatgcgccggcccaacttccaggccctgtcggggaacgaacgcttcgagggcttctgcgtggacatgctgcgggagctggccgagctgctgcgcttccgctaccgcctgcggttggtggaggatgggctgtacggggcgcccgagcccaacggctcctggacgggcatggttggcgagctcatcaaccggaaggcagacctggctgtggccgccttcaccatcacagctgagcgggagaaggtcatcgacttttccaagccctttatgaccctggggatcagcatcctctaccgagtgcacatgggccgcaagcctggctacttctccttcctggaccccttctcccctgctgtgtggctcttcatgcttcttgcctacctggctgtcagctgcgtcctgtttctggctgccaggctgagcccctatgagtggtataacccacacccatgcctgcgggcacgcccccacatcctggagaaccagtacacgctgggcaacagcctgtggtttcccgtggggggcttcatgcagcagggctcggagatcatgccccgggcgctgtccacgcgctgtgtcagcggagtctggtgggccttcaccttgatcatcatctcctcctacacggccaacctggccgccttcctcaccgtgcagcgcatggaggtgcctgtggagtcggccgatgacctggcagatcagaccaacatcgagtatggcaccatccacgccggctccaccatgaccttcttccagaattcacggtaccaaacgtaccagcgcatgtggaactacatgcagtcgaagcagcccagcgtgttcgtcaagagcacagaagagggcattgcccgcgtcctcaactcccgctacgccttcctgctcgagtccaccatgaacgaataccaccggcgcctcaactgcaacctcacccagatcgggggactcctcgacaccaagggctacggcattggcatgccgctgggctccccgttccgggatgagatcacactggccatcctgcagcttcaggagaacaaccggctggagatcctgaagcgcaagtggtgggaggggggccggtgccccaaggaggaggaccatcgagctaaaggtttgggcatggagaacattggtggcatttttatcgtgctcatctgtggcctcatcattgctgtcttcgtggcggtcatggaattcatatggtccacacggaggtcagctgagtccgaggaggtgtcggtgtgccaggagatgctgcaggagctgcgccacgccgtttcttgccgcaagacgtcgcgttcccgccggcgccgacgcccgggcggcccgagccgggccctgctgtcactgcgcgcggtccgcgagatgcgcctcagcaacggcaagctctactcggccggcgcgggcggggatgcgggcagcgcgcacgggggcccgcagcgcctcctggacgacccggggccccccagcggagcccgacccgccgcccccaccccctgcacccacgtgcgcgtctgccaggagtgccggcgcatccaggcgctgcgggcctcgggggccggcgcgcctccgcgtggcctgggcgtccccgccgaagccaccagcccgccccggccgcggcctggccccgccggcccccgggagctggcggagcacgagtgaccacgggcggggctgtgcgggcgcccggactgaccgaagggacggggcccgccccaggccccagcagtctccgctcccgcagcgggcgcgggacaggacttgtgcgccggcgccccggacgccgcgattttgcctttggttccccgcgaagtccgaggcctggctctggagcccgcctgcgccccccagtggactcgcgagagggtgccgcgggcgagaagggcgcaggaaccgaggactccaggggctggggacttcgggggcggctctgggaagcggaaagcagtcagcggagaggaccccattctgggactgctcaggctccccaagacttgacgcagccccccacgcttctggaggtggggagggcctctggacagatgggtgtcccctggtgcccctccactcttctcttcctctcttttttggggggagaaacctcggaatttctatgagacctcccccagggagggggtcagttgggcccccatccctccccttgccacatcgcagcccctgttggaataaaaaaaagaacaaaaccccagaa

SEQ ID NO: 137489 - DNA, 3310 bp, Homo sapiens
  Payload ID: 6916
  Gene Symbol: GRIK5
  Gene Name: glutamate receptor, ionotropic, kainate 5
  Uniprot ID: Q16478
  ENST ID: ENST00000301218
  CDS Start-End: 36-2981
cgcggcagctgcgtccccatgaggaggggaggaagatgccggctgagctgctgctgctgctgattgttgccttcgccagccccagctgccaggtgctctcatcactgcgcatggctgcaatcctggatgatcagacagtgtgtggccgcggtgagcgtctggccttggccttggcccgggagcagatcaacgggatcatcgaggtcccagccaaggcccgagtggaagtagacatctttgagctgcagcgggacagccagtacgagaccacggacaccatgtgtcagatcttacccaaaggggttgtgtctgtccttgggccctcctctagcccagcatctgcctccaccgtgagccatatctgtggagagaaggagatcccccacatcaaggtgggtcccgaggagacaccccgccttcagtaccttcgcttcgcgtctgtcagcctgtaccccagtaacgaggacgtcagcttggcggtctcccgaatcctcaagtccttcaactacccctcggccagcctcatctgcgccaaggctgagtgcctgctgcgattggaggaactggtgcgtggcttcctcatctccaaggagacgctgtcagtgaggatgttggacgacagccgggaccccacaccactgctcaaggagatccgtgatgacaaggtgtccaccatcatcatcgacgccaacgcctccatctcccacctcatcctccgtaaggcctcggaactgggaatgacctcagcgttttacaagtacatcctcaccaccatggacttccccatcctgcatctggacggtattgtggaggactcctccaacatcctgggcttctccatgttcaacacgtcccaccccttctaccctgagtttgtccgcagcctcaacatgtcctggagggagaactgtgaagccagcacctacctgggccctgcgctgtcagccgccctgatgtttgacgccgtgcacgtggtggtgagcgctgtccgagagctgaaccgcagccaggagatcggtgtgaagcctctggcctgtacatcggccaacatttggccccacgggaccagcctcatgaactacctgcgcatggtagagtatgatgggctgaccgggcgggtcgagttcaacagcaaagggcagagaaccaactacaccctgcgcatcctagaaaagtcccggcagggccaccgtgagattggggtgtggtactctaaccgcaccctggccatgaatgccaccaccctggacatcaacctgtcgcagacactggccaacaagaccctggtggtcacaaccatcctggagaacccatacgtcatgcgccggcccaacttccaggccctgtcggggaacgaacgcttcgagggcttctgcgtggacatgctgcgggagctggccgagctgctgcgcttccgctaccgcctgcggttggtggaggatgggctgtacggggcgcccgagcccaacggctcctggacgggcatggttggcgagctcatcaaccggaaggcagacctggctgtggccgccttcaccatcacagctgagcgggagaaggtcatcgacttttccaagccctttatgaccctggggatcagcatcctctaccgagtgcacatgggccgcaagcctggctacttctccttcctggaccccttctcccctgctgtgtggctcttcatgcttcttgcctacctggctgtcagctgcgtcctgtttctggctgccaggctgagcccctatgagtggtataacccacacccatgcctgcgggcacgcccccacatcctggagaaccagtacacgctgggcaacagcctgtggtttcccgtggggggcttcatgcagcagggctcggagatcatgccccgggcgctgtccacgcgctgtgtcagcggagtctggtgggccttcaccttgatcatcatctcctcctacacggccaacctggccgccttcctcaccgtgcagcgcatggaggtgcctgtggagtcggccgatgacctggcagatcagaccaacatcgagtatggcaccatccacgccggctccaccatgaccttcttccagaattcacggtaccaaacgtaccagcgcatgtggaactacatgcagtcgaagcagcccagcgtgttcgtcaagagcacagaagagggcattgcccgcgtcctcaactcccgctacgccttcctgctcgagtccaccatgaacgaataccaccggcgcctcaactgcaacctcacccagatcgggggactcctcgacaccaagggctacggcattggcatgccgctgggctccccgttccgggatgagatcacactggccatcctgcagcttcaggagaacaaccggctggagatcctgaagcgcaagtggtgggaggggggccggtgccccaaggaggaggaccatcgagctaaaggtttgggcatggagaacattggtggcatttttatcgtgctcatctgtggcctcatcattgctgtcttcgtggcggtcatggaattcatatggtccacacggaggtcagctgagtccgaggagaccccagctctgcatccagctgcctgccagtgttctgcacttggcccaaggactcctctgaaggagccgtccatgctgctagtaaaggtgccctccacccgtgtccaggttgccttctcaaggacatccctccggcaagtctgtcctttcctcctgcagcatcagttgtcctctctttattggattcaggccaccaacgtacaaatatgctgtcatttctccagtcttaaaccctctcctgacctcactttccctcccagccaccgcccactttcttcccttctctttacagccttggcagcagtggggggtctccctgatgcttccagtttcttctttcctcccatttcctcttgccccccactccagtctggcatcggtccctgccactccactgaagccactcttgtcaccagcaacttccatgtctgaaattcccggtctcaggcctcatgtatatgaggtagcagtgggcttcggcacagccagtcactctcaatcctcaaagccccttcttccccttctcccacttctccggtcactccttcccaggctccctcgttgggtttctctttctccccaggctctgtttgttgtggggctccagggctcagtccttagactgcttctcttctcggtctttctccactacttgaatgatcccaccagccaaatggctcttaagacccactatgtgctggtgattcttgtgttagttatctattgctatcataacaaatgaccttaacagcttttaaaaa

SEQ ID NO: 137490 - DNA, 2101 bp, Homo sapiens
  Payload ID: 6916
  Gene Symbol: GRIK5
  Gene Name: glutamate receptor, ionotropic, kainate 5
  ENST ID: ENST00000594528
  CDS Start-End: 36-368
cgcggcagctgcgtccccatgaggaggggaggaagatgccggctgagctgctgctgctgctgattgttgccttcgccagccccagctgccaggtgctctcatcactgcgcatggctgcaatcctggatgatcagacagtgtgtggccgcggtgagcgtctggccttggccttggcccgggagcagatcaacgggatcatcgaggtcccagccaaggcccgagtggaagtagacatctttgagctgcagcgggacagccagtacgagaccacggacaccattgccatggctagaagaatggagttctgtgactccccaaggcctgcatcaggtgccagtcaatcctgggaaccctggactgaagggtgaggatagttcccccaggagaagttagggttctgccatgagaacaggcactggacaagcaaaaacaacagctttccacctcccagtcttgagacacacatgtgtataaggaggaagagagcagaagaaagaggaggaatgtgtcagatcttacccaaaggggttgtgtctgtccttgggccctcctctagcccagcatctgcctccaccgtgagccatatctgtggagagaaggagatcccccacatcaaggtgggtcccgaggagacaccccgccttcagtaccttcgcttcgcgtctgtcagcctgtaccccagtaacgaggacgtcagcttggcggtctcccgaatcctcaagtccttcaactacccctcggccagcctcatctgcgccaaggctgagtgcctgctgcgattggaggaactggtgcgtggcttcctcatctccaaggagacgctgtcagtgaggatgttggacgacagccgggaccccacaccactgctcaaggagatccgtgatgacaaggtgtccaccatcatcatcgacgccaacgcctccatctcccacctcatcctccgtaaggcctcggaactgggaatgacctcagcgttttacaagtacatcctcaccaccatggacttccccatcctgcatctggacggtattgtggaggactcctccaacatcctgggcttctccatgttcaacacgtcccaccccttctaccctgagtttgtccgcagcctcaacatgtcctggagggagaactgtgaagccagcacctacctgggccctgcgctgtcagccgccctgatgtttgacgccgtgcacgtggtggtgagcgctgtccgagagctgaaccgcagccaggagatcggtgtgaagcctctggcctgtacatcggccaacatttggccccacgggaccagcctcatgaactacctgcgcatggtagagtatgatgggctgaccgggcgggtcgagttcaacagcaaagggcagagaaccaactacaccctgcgcatcctagaaaagtcccggcagggccaccgtgagattggggtgtggtactctaaccgcaccctggccatgaatgccaccaccctggacatcaacctgtcgcagacactggccaacaagaccctggtggtcacaaccatcctggagaacccatacgtcatgcgccggcccaacttccaggccctgtcggggaacgaacgcttcgagggcttctgcgtggacatgctgcgggagctggccgagctgctgcgcttccgctaccgcctgcggttggtggaggatgggctgtacggggcgcccgagcccaacggctcctggacgggcatggttggcgagctcatcaaccggaaggcagacctggctgtggccgccttcaccatcacagctgagcgggagaaggtcatcgacttttccaagccctttatgaccctggggatcagcatcctctaccgagtgcacatgggccgcaagcctggctacttctccttcctggaccccttctcccctgctgtgtggctcttcatgcttcttgcctacctggctgtcagctgcgtcctgtttctggctgccaggctgagcccctatgagtggtataacccacacccatgcctgcgggcacgcccccacatcctggagaaccagtacacgctgggcaacagcctgtggtttcccgtggggggcttcatgcagcagggctcggagatcatgccccgggc

SEQ ID NO: 137491 - DNA, 3308 bp, Homo sapiens
  Payload ID: 6916
  Gene Symbol: GRIK5
  Gene Name: glutamate receptor, ionotropic, kainate 5
  Uniprot ID: Q16478
  ENST ID: ENST00000593562
  CDS Start-End: 309-3251
ccccttctctcctccattttctcctttccccttcctcccctccccggcccgccctctcctcttccacctgtccttcctccctgctcctgtggagccaccgttttggattagttgggagccaccaccggcggcgggggagggggccctgtggactgccctctccccccgcccagccccaccaccacccagcgccagagcacctcccgctgtcggtcttcgggcctcgagggagcccagccctccgtcccaccaggatccgtggcgagtgggggccgcggcagctgcgtccccatgaggaggggaggaagatgccggctgagctgctgctgctgctgattgttgccttcgccagccccagctgccaggtgctctcatcactgcgcatggctgcaatcctggatgatcagacagtgtgtggccgcggtgagcgtctggccttggccttggcccgggagcagatcaacgggatcatcgaggtcccagccaaggcccgagtggaagtagacatctttgagctgcagcgggacagccagtacgagaccacggacaccatgtgtcagatcttacccaaaggggttgtgtctgtccttgggccctcctctagcccagcatctgcctccaccgtgagccatatctgtggagagaaggagatcccccacatcaaggtgggtcccgaggagacaccccgccttcagtaccttcgcttcgcgtctgtcagcctgtaccccagtaacgaggacgtcagcttggcggtctcccgaatcctcaagtccttcaactacccctcggccagcctcatctgcgccaaggctgagtgcctgctgcgattggaggaactggtgcgtggcttcctcatctccaaggagacgctgtcagtgaggatgttggacgacagccgggaccccacaccactgctcaaggagatccgtgatgacaaggtgtccaccatcatcatcgacgccaacgcctccatctcccacctcatcctccgtaaggcctcggaactgggaatgacctcagcgttttacaagtacatcctcaccaccatggacttccccatcctgcatctggacggtattgtggaggactcctccaacatcctgggcttctccatgttcaacacgtcccaccccttctaccctgagtttgtccgcagcctcaacatgtcctggagggagaactgtgaagccagcacctacctgggccctgcgctgtcagccgccctgatgtttgacgccgtgcacgtggtggtgagcgctgtccgagagctgaaccgcagccaggagatcggtgtgaagcctctggcctgtacatcggccaacatttggccccacgggaccagcctcatgaactacctgcgcatggtagagtatgatgggctgaccgggcgggtcgagttcaacagcaaagggcagagaaccaactacaccctgcgcatcctagaaaagtcccggcagggccaccgtgagattggggtgtggtactctaaccgcaccctggccatgaatgccaccaccctggacatcaacctgtcgcagacactggccaacaagaccctggtggtcacaaccatcctggagaacccatacgtcatgcgccggcccaacttccaggccctgtcggggaacgaacgcttcgagggcttctgcgtggacatgctgcgggagctggccgagctgctgcgcttccgctaccgcctgcggttggtggaggatgggctgtacggggcgcccgagcccaacggctcctggacgggcatggttggcgagctcatcaaccggaaggcagacctggctgtggccgccttcaccatcacagctgagcgggagaaggtcatcgacttttccaagccctttatgaccctggggatcagcatcctctaccgagtgcacatgggccgcaagcctggctacttctccttcctggaccccttctcccctgctgtgtggctcttcatgcttcttgcctacctggctgtcagctgcgtcctgtttctggctgccaggctgagcccctatgagtggtataacccacacccatgcctgcgggcacgcccccacatcctggagaaccagtacacgctgggcaacagcctgtggtttcccgtggggggcttcatgcagcagggctcggagatcatgccccgggcgctgtccacgcgctgtgtcagcggagtctggtgggccttcaccttgatcatcatctcctcctacacggccaacctggccgccttcctcaccgtgcagcgcatggaggtgcctgtggagtcggccgatgacctggcagatcagaccaacatcgagtatggcaccatccacgccggctccaccatgaccttcttccagaattcacggtaccaaacgtaccagcgcatgtggaactacatgcagtcgaagcagcccagcgtgttcgtcaagagcacagaagagggcattgcccgcgtcctcaactcccgctacgccttcctgctcgagtccaccatgaacgaataccaccggcgcctcaactgcaacctcacccagatcgggggactcctcgacaccaagggctacggcattggcatgccgctgggctccccgttccgggatgagatcacactggccatcctgcagcttcaggagaacaaccggctggagatcctgaagcgcaagtggtgggaggggggccggtgccccaaggaggaggaccatcgagctaaaggtttgggcatggagaacattggtggcatttttatcgtgctcatctgtggcctcatcattgctgtcttcgtggcggtcatggaattcatatggtccacacggaggtcagctgagtccgaggaggtgtcggtgtgccaggagatgctgcaggagctgcgccacgccgtttcttgccgcaagacgtcgcgttcccgccggcgccgacgcccgggcggcccgagccgggccctgctgtcactgcgcgcggtccgcgagatgcgcctcagcaacggcaagctctactcggccggcgcgggcggggatgcgggcagcgcgcacgggggcccgcagcgcctcctggacgacccggggccccccagcggagcccgacccgccgcccccaccccctgcacccacgtgcgcgtctgccaggagtgccggcgcatccaggcgctgcgggcctcgggggccggcgcgcctccgcgtggcctgggcgtccccgccgaagccaccagcccgccccggccgcggcctggccccgccggcccccgggagctggcggagcacgagtgaccacgggcggggctgtgcgggcgcccggactgaccgaagggacggggcccgccccag

SEQ ID NO: 137492 - DNA, 4465 bp, Homo sapiens
  Payload ID: 6917
  Gene Symbol: GRIN1
  Gene Name: glutamate receptor, ionotropic, N-methyl D-aspartate 1
  ENST ID: ENST00000350902
  CDS Start-End: 313-1383
ccggaaccagcgccgtccgcggagccgccgccgccgccgccgggccctttccaagccgggcgctcggagctgtgcccggccccgcttcagcaccgcggacagcgccggccgcgtggggctgagccccgagcccccgcgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacgctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggtagggcaggccaccctccgaggcctggtgcccagggcccggcctggccacggccctcctccatccccgaaggccgtggcactggctctggctctggtgggcaggactggagctaggagccatggccaggggcagtggtgagtgctcccagggcacgggggcagcaccggtggggggctgcctgcaggtggctgcccactgcaaagccggggccgagggaggccacgcaccctgctccaagcctccgcctggcccctctgtctccagagtcgcccgccggtacccattccataggaaggcaatcaggcagggtaagacaggggcccgcctgtgtatggcacgtgagtccaagatgcattttgccctccgccgacccaagccccttgacacccttcggagacccccccctttcctgctatgtccttgtgctccgtgactctaatccgaattgggccaggtccggtcctgcctggtgcccaggttgtatccatgagaatttgccaccagcaagggcagccacggcccacctgggacagggtgggcagtgggcctgtacaggcctaagggctcgtggcccgcggtcgagttccggttcactccgtctcttctctttctctgggtgccgtcctggagcctgtgtcctgagatgaagccgacagtgcggccagggctgctgggggatgggggttgctggaggctccacacctctcatccgcccgctcttgctcttggcccccacaggtcccctggggacctggccgctgccagcactggcgggcacaggccacctggccatcagacctgaggccagagtcccgggagctgcctctgtcactccaattccacctcgacacctgcctccagccctcggccccttcctgaatcttggtgtgtgccccttgggggtcagtggcctccacgcagacagctggtgtggcctgaggggcaactcctccagtcctcagaggactcctcctcctcgggacgcctgtaagccagggccacccaggagccagggagccaggcggacctcccaggaagagccagccgagagcccccaagcccagccccagcacgagcaaggtcaggcccgagaccccgggcaggagaagaggccaccctcgaacgtccgctgtcggcccgtctgtccagcacagggaggcaggcaggagcgagggcccaagtggccggccaggctgggcagcggcccatgcaggagcaggcgagggcaggtgtggccaccaccctagccatctaatcacttatacatattcattttaggatagaaagagtggtagagcagagcctgaccctaaaaagaaagccacatttagggctatcacctccaccctggcttccagcttcaagaggcgtaggtcctccaaagacacggtaagggggagagcaccccagtcccgcgtccgactccacctgccctgccctgcgtgtgtctcccgccccatcaccccgccccggaccctgggctcctgtggcccactctgcccctgtctccctgtg

SEQ ID NO: 137493 - DNA, 4114 bp, Homo sapiens
  Payload ID: 6917
  Gene Symbol: GRIN1
  Gene Name: glutamate receptor, ionotropic, N-methyl D-aspartate 1
  Uniprot ID: Q05586
  ENST ID: ENST00000371546
  CDS Start-End: 7-2886
gagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgagcaccgggggtggacgcggcgctttgcaaaaccaaaaagacacagtgctgccgcgacgcgctattgagagggaggagggccagctgcagctgtgttcccgtcatagggagagctgagactccccgcccgccctcctctgccccctcccccgcagacagacagacagacggacgggacagcggcccggcccacgcagagccccggagcaccacggggtcgggggaggagcacccccagcctcccccaggctgcgcctgcccgcccgccggttggccggctggccggtccaccccgtcccggccccgcgcgtgcccccagcgtggggctaacgggcgccttgtctgtgtatttctattttgcagcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgc

SEQ ID NO: 137494 - DNA, 3940 bp, Homo sapiens
  Payload ID: 6917
  Gene Symbol: GRIN1
  Gene Name: glutamate receptor, ionotropic, N-methyl D-aspartate 1
  Uniprot ID: Q05586
  ENST ID: ENST00000371550
  CDS Start-End: 7-2712
gagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcagagcaccgggggtggacgcggcgctttgcaaaaccaaaaagacacagtgctgccgcgacgcgctattgagagggaggagggccagctgcagctgtgttcccgtcatagggagagctgagactccccgcccgccctcctctgccccctcccccgcagacagacagacagacggacgggacagcggcccggcccacgcagagccccggagcaccacggggtcgggggaggagcacccccagcctcccccaggctgcgcctgcccgcccgccggttggccggctggccggtccaccccgtcccggccccgcgcgtgcccccagcgtggggctaacgggcgccttgtctgtgtatttctattttgcagcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgc

SEQ ID NO: 137495 - DNA, 3751 bp, Homo sapiens
  Payload ID: 6917
  Gene Symbol: GRIN1
  Gene Name: glutamate receptor, ionotropic, N-methyl D-aspartate 1
  Uniprot ID: Q05586
  ENST ID: ENST00000371553
  CDS Start-End: 7-2838
gagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgc

SEQ ID NO: 137496 - DNA, 4003 bp, Homo sapiens
  Payload ID: 6917
  Gene Symbol: GRIN1
  Gene Name: glutamate receptor, ionotropic, N-methyl D-aspartate 1
  ENST ID: ENST00000371555
  CDS Start-End: 7-2775
gagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcagagcaccgggggtggacgcggcgctttgcaaaaccaaaaagacacagtgctgccgcgacgcgctattgagagggaggagggccagctgcagctgtgttcccgtcatagggagagctgagactccccgcccgccctcctctgccccctcccccgcagacagacagacagacggacgggacagcggcccggcccacgcagagccccggagcaccacggggtcgggggaggagcacccccagcctcccccaggctgcgcctgcccgcccgccggttggccggctggccggtccaccccgtcccggccccgcgcgtgcccccagcgtggggctaacgggcgccttgtctgtgtatttctattttgcagcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgc

SEQ ID NO: 137497 - DNA, 3577 bp, Homo sapiens
  Payload ID: 6917
  Gene Symbol: GRIN1
  Gene Name: glutamate receptor, ionotropic, N-methyl D-aspartate 1
  Uniprot ID: Q05586
  ENST ID: ENST00000371559
  CDS Start-End: 7-2664
gagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcagcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgc

SEQ ID NO: 137498 - DNA, 3640 bp, Homo sapiens
  Payload ID: 6917
  Gene Symbol: GRIN1
  Gene Name: glutamate receptor, ionotropic, N-methyl D-aspartate 1
  Uniprot ID: Q05586
  ENST ID: ENST00000371560
  CDS Start-End: 7-2727
gagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcagcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgc

SEQ ID NO: 137499 - DNA, 5149 bp, Homo sapiens
  Payload ID: 6917
  Gene Symbol: GRIN1
  Gene Name: glutamate receptor, ionotropic, N-methyl D-aspartate 1
  Uniprot ID: Q05586
  ENST ID: ENST00000371561
  CDS Start-End: 1098-3914
ggtaaggctctggaaaagggggcgctgggagcgcattgcgagggggctggagagggagagaggagcggaagctgagggtgtgaaacggctggccccgaacacacctcgcggcgctccagtgattcctggtgtccgacctcagccccagtcagtgcgggtccagtttccaggctctcgcggaaggcctggctgagcacatgcggcagccacggtcaccctccctattcctcttagcccgaggaggggggtcccaagttacatggccacgcagatggggcctctccctcatttctgaaccttgtggggaggggaaccttgaagggagcgccccccagagccatggcttagggcctcccccacccctctggagctccagtctgcaagagtcaggagccgaaatatcgctgactgtgggtgacgactcttgcgcgcacacacacatacaagcgggcacgacgcgttcggtcctattaaaaggcacgcaagggtgcgggctgcacgcggtgacacggacccctctaacgtttccaaactgagctccctgcaggtccccgacagcacaggcccctgtcccaggacccctccaggcacgcgctcacacgcacacgcgcgctccccggctcacgcgcgctccgacacacacgctcacgcgaacgcaggcgcacgctctggcgcgggaggcgcccccttcgcctccgtgttgggaagcgggggcggcgggaggggcaggagacgttggccccgctcgcgtttctgcagctgctgcagtcgccgcagcgtccggaccggaaccagcgccgtccgcggagccgccgccgccgccgccgggccctttccaagccgggcgctcggagctgtgcccggccccgcttcagcaccgcggacagcgccggccgcgtggggctgagccccgagcccccgcgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgagcaccgggggtggacgcggcgctttgcaaaaccaaaaagacacagtgctgccgcgacgcgctattgagagggaggagggccagctgcagctgtgttcccgtcatagggagagctgagactccccgcccgccctcctctgccccctcccccgcagacagacagacagacggacgggacagcggcccggcccacgcagagccccggagcaccacggggtcgggggaggagcacccccagcctcccccaggctgcgcctgcccgcccgccggttggccggctggccggtccaccccgtcccggccccgcgcgtgcccccagcgtggggctaacgggcgccttgtctgtgtatttctattttgcagcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgcagttttc

SEQ ID NO: 137500 - DNA, 5031 bp, Homo sapiens
  Payload ID: 6918
  Gene Symbol: GRIN2A
  Gene Name: glutamate receptor, ionotropic, N-methyl D-aspartate 2A
  Uniprot ID: Q12879
  ENST ID: ENST00000330684
  CDS Start-End: 549-4943
cgctcagcagctcccggtcgcacaactcccagcagccggcgctggggaggtggtagggggtgcgggtggaggtgcccagttagcttctcgtgggtggccaacctggggctcccattctcctgtgcaccctggagtggagctcccgctatcagccacaggggctgaggatccgcactgggggcgtcgtgggcatcgggcttcagcttcccccctcttgtctagcccccctgggcgcataggggggcttgtgagcactgcagactgcagccttcccctcaaccctccctcccctcgttggtgggctgaccctgcctctccttctctcctccgccccgttagagccctgctgcagagcctccggctgggatagccgccccccgtgggggcgatgcggacagcgcgggacagccaggggagcgcgctggggccgcagcatgcgggaacccgctaaacccggtggctgctgaggcggccgagatgctcgtgcgcgcagcgcgccccactgcatcctcgaccttctcgggctacagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacaggtaacccagccaccggggagcaggtctaccagcaggactgggcacagaacaatgcccttcaattacaaaagaacaagctaaggattagccgtcagcattcctacgataacattgtcgacaaacctagggagctagaccttagcaggccctcccggagcataagcctcaaggacagggaacggcttctggagggaaatttttacggcagcctgtttagtgtcccctcaagcaaactctcggggaaaaaaagctcccttttcccccaaggtctggaggacagcaagaggagcaagtctctcttgccagaccacacctccgataaccctttcctccactcccacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccct

SEQ ID NO: 137501 - DNA, 14450 bp, Homo sapiens
  Payload ID: 6918
  Gene Symbol: GRIN2A
  Gene Name: glutamate receptor, ionotropic, N-methyl D-aspartate 2A
  Uniprot ID: Q12879
  ENST ID: ENST00000396573
  CDS Start-End: 311-4705
atcatgggaccgggtgagcgctgagaatcgcggccgcagccatcagccctggagatgaccaggagcggccactgctgagaactatgtggagagaggctgcgagccctgctgcagagcctccggctgggatagccgccccccgtgggggcgatgcggacagcgcgggacagccaggggagcgcgctggggccgcagcatgcgggaacccgctaaacccggtggctgctgaggcggccgagatgctcgtgcgcgcagcgcgccccactgcatcctcgaccttctcgggctacagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacaggtaacccagccaccggggagcaggtctaccagcaggactgggcacagaacaatgcccttcaattacaaaagaacaagctaaggattagccgtcagcattcctacgataacattgtcgacaaacctagggagctagaccttagcaggccctcccggagcataagcctcaaggacagggaacggcttctggagggaaatttttacggcagcctgtttagtgtcccctcaagcaaactctcggggaaaaaaagctcccttttcccccaaggtctggaggacagcaagaggagcaagtctctcttgccagaccacacctccgataaccctttcctccactcccacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaacagttaagaatgcatctgcactgtagtgcgattgacatgtgcaagagattaggaagtttggctcgtaacagtttcagctttcttgttatgccttccatcacagcccaggctcaccccaagaactccaggctcccctaaagaatagcaaatcagtgtgttcgtgatgactgtgctaccttcattatagttcatttccaagacacatctggagccaaaggcccgagggaccctcaggtggggagagctacaggaatctctttggatgttgatgtgtgtttctctcaccctcggcttcgatggtcttgttcagagctgcataaactaacacatttatgtctccgagatctaagtgtggatcttctgtctgtgacacagtggccattgtagtttatcccgaagacgcctatgtacgtaagtttgcatttcctcccttctggtgatgactcagggttgtatagtatctgttaccccttccctcccagagtaaccataactcgttccgtttccaaacagccatggtggtgtccaattagctgtgtatcgctcttcccagagttgttaatgtggtgacatgcaccaacagccgtatgtgtactgtgatctgtaagaagtacaatgccatctgtctgccgaaggctagcatggttttaggtttatcttccttcacatccagaaattctgttggacactcacttccaccccaaactcctcaaatcaaaagccttcaaaacacgaggcactcttggatctaccctgagtatcctccaaactgtggatacagtttagtgagacaagcaatttctcccttctgagttattctctctgttggtggcaaaccacttcatagcaccaacagagatgtaggaaaaattcctcaaagtatttgtcatttctgagtcgcctgcattatcccattcttattctcctcaaacctgtgcatatatgacatgaaatgatatccattttttttttaagttagagacagagaggggaatacttatgcatggggagcctgttagcacagtgcctgccacaaaaacaagtgcccccgacaagatagttgctatgttatgacactttctcagatcaggattttctagtttaaaaattaaatatcataaaaccagcaaataatattaactaaaccttttatatagttctactctgttaattagtgtatttcatgtacatgaatatttttgaagtatttgggataactagccatcagtgtttgcagaagacctcagtctgttttgggccattacggaaacactaagctaatgtagactcgcctggccatttcctggtttcctcctgcattctgctttacattcttgaagaaagggataaagtggcaggttgaaaaattatcccatttcttctcctcatggtgtgcgttctgttttgtaagtattattttcttgcatgtgggcaagtgtcagggatgattcccttaaagctcaaggatgcatggaatagctccatctttgggaaagtacacctgacctacagtgttcctataatgaaaagtggttgcaataaatttcagggtcaatcatagggagacagagggaggcagtgggtgagaggagcttcctttcatttttgaaaggcagaaggggctgactaggtgctggggatgcatgtgcttgaaaatgacattttatttcccggatgctgtacctctgctgccccaagacccagccatggagaagcctggatcgaagggcccagaatagtcaccccaacatctgatcctaaatctgaatctccatgactgtgtagccttttagccctttctaccttctgcccttccagtgcattccagaccttaatccaccccagcaaggatcgcctccatttcctcatgagtctgggatgttttgacatgaatgaattaaaaagtcttcccagaatacagaagagtgatttgtcgtcaagccaaagaggctttctgtcttcctctggtgtcctctaaacccagggggctgccaaatgccacagagacctccagggagagtgagagttatacttggactgacttcatcggtcagaaagccttcccctaacagcagcattatttctgctattaaccccatacatctctggataaagaaactgaaaacgtggcctttggaagaatcaacagtaatgttgtgaaaaaaatatatattcttttcactgaccgaagtgttttttcaaataaataatcagaaatgttatgctacacaaagtttatggtatcccttctctactaattcaatgactcttcaatgtgatgatcccaagcaaaaaaaaaaaaaaaaaaaaaaaatcaactactgatcagatggtcaatttctaaggaaaagatgtagagttattcaaaggtcatctaagtcagttcagtctttgcaaaaagaatatcaggaatgtaacgtccagtggtaaatggaacccacagtatgagaagtaacaagaattaaataggaagcctggaagcctgagactatagatctatcacagaagattcccgtaacatatcccagctctgagttcttagatttgttgatgtcaaggagcccaaatttctgaacacaaatgcctgagtttcagctggcttaagtcagagctggcatccataatgatattttgttaattctaattggttttccccacttgagaaggacccaactagtcctcagataggtacacttgaatgcaaacggttgggtctctgtccatgggtaatagcacgcacatgcaaccaatttaaaatactctgggtaagagagtcttctagagcataaactgtacttgagaaacctttgtgcttctggaaaatgggtttcatcatccttacatctgcaggttcttaggccacttatggtttcaatgctctgagctggcaagtccctataggtctatctttctgccagagagacttgcaggattataatctcacaatctcaccactcattactgttatgtcctctgcaaatctctctgcgttattttagccagcaccatgactgggcatccacggattactcttgattttctcttccctgattcacaggatgccagagagtctgagtatttagtttttctggtgaaagcattaaaattcacacattgcagcaaaatctgtcaaatcatttcacgcttattttctggggagaaaaatagaaaattacaccttgtttacaaatgaaatagtttcacttaaatgggactctagccaaggcagttaattagtcaaaagatccacagctgtcatatagtcacacattgtttattctatttgctatgtcgaccactgatgtgtatttaatattctgcatccttcacaggaaatgacaaatgccctgaattatttgcaaatagaattgctaatgaaaaagaaaaaaaatgttgatgttaattaaatggtgattaaaaatttatctcctttaaatctaaaaagtgcagctttaataatcagttgtcatataaataagtaccttgtactgaaatcccttgcggtttaagacctaaataaacactaatttgagaactctaaataccttacagaggagctggatatattcgttaacattatgcacattcctgtactgtttctttgtgcatagctgttgtgcatgaatccttgaaaaggggacatgcgttgtttctgaaatggagcctgtttgtattaaccatggctatagtagacatgattggactcaaagaaaaagaagtttgagtaggtggaagctaaatgtgttgcttgatatttaatgagtgaagggttctatgtaaaggcaattttccttccaaaagtactgtttattttcactggagacaaaattagacctttccagataccccatctctttttggtgaacagggttgaaagtgctgtggggtctatacttgaaaagttctcccaatatgcagttactgtttcccattcaatccctatacattgtactgtgttcatatctaattgtatcagatgaggtcagcttgccacttgatatagatcagagatgatcaaatgcacttatcctgtgaatacaactgcttgtgtacacatgtatataatatacatgcttgatttctacaattcacacgtaagtgtattatccaaataaaattgtacatattgtaaagtttatgttaaaaattaaatggtgatgatggtattaacacatggaaaacccattctggttatttttatgggaggatatttctgtagagagggcactatatttttttaatctcagttgtagggaggatgacagagcctaagtagaatatgggtgttggcgttcttggccccttctttaaaaaacaaaactctgggatgaggggtatagaatatattctgctcgcatttgcttctgaagacaatgccgatatggacttgtgtgtgatttccttaaacacatcaaagggcatagatttcctatttaaattccttatcctctttcctcacctgcactctttctgtgcccagcagtactttcagtatagtattagctagaagtgcctgcccagaagggtcttagaaaaatagagttcgtagaaccacaccaaaagttaggagaaggggaggagagatgagaaaaatgaagtttacaaatgggcagttgcctgtttaagatcatcaagttagagagtatcagagcgaggattagatccaagacatggttcaatttctggctcgattctctgaccgggctgacttatttctaggtttctttcaaggggaaactcctgagtagctctggaataagagccagagatccccataaggctgccctggtttttgttttgttttgttttttgtttttgccacttgccccagaaagacctacccatgcttctttgaatttggttttcctttaaactccctcacaatccctgtcttaaagttcctagaagagaaaacttttctcagagaccgtctccttaggaaaaatcaacagggatattgtttaaaacctcaaactgaagataaaaggctggcagtgaccattgaaataattgaggtctatgtatcatgcattgaggaagaaccaagcacattgaccagctaataggacttcactgaatgtccactttattttgaaagccagtttgggattgtgggggaggggatgcaaaataaatagaaaatatagtctcttcccataagtagcttatggtttagaagttcagttctctaatacaaaggataaccaaggacccatgcaatgcaaacagagactaaacagcaaaaattagaaatgacaactaaagttgtagccaggaaaaaaaaaataatctgattctatgagcataccttttttaaaaaaaaaaaaaaagtccttccctaaacctttaagtaactccggagaatagagttagtggtcccggaaatgcagttgatttattttaatcttcaaataatggacttaggagacccaggagctgctaaccaggtgaacacactcacactcctacatttttgcacaggaaggcttttgtctggttccaaccagttctccagtccttgccaaatcatgcctcctcccagccttgcattatgacatgtgcctcaagaaaaggttgaaaaaattccccaaaggattagaaaatagaccatgatgtaaaaagacgaagcatttccctaaagcttttttgtttggttttgtttttgacatttgaagaacccttctgatacaccagggtatgaatgtatcagggaagcatagagggaaaattctttatcaagttccaagtgcctactgctgtggctgacagaaagcatcaggttccctagagagaaaacggggcaaagagatggcaaaaggaatagaggtgtatttcaggaaggatggcgaggtggagagggagcttttgtcactctgtctatcccattctgtgcattcttggaatgttacattttctgcttatcgcaagtacttgccatggatctgcacctgaatttgaaaatatcaaaatatatctaaattgagtgtaggcgatattctaggcatatcctagaatgtgatcctcaaaacaaccttaagatataaatatgattgctcccattttacagataaggaaactgaggctcaggtttttctcaacctcgtcagcaactagaattagctagtaaatccctaacgttagacatattttcaaagtgcctggtctcctccagggaggtcagaatagaagtcagaaagagaggtgtgctcttttgaggttcctgggcatatacccttgagtatcagcctctgtgacagggaagtctgttagggtcttacccctcattgcctgatctgtgtgtatggagaacttctggggatctcacctctgttcatagttccttctgagacttgaacactgtttgtgtctccctttcatatgcttgcacttagcatttaaaaaaatttctggggagttattttctctacttagcatgtgcctaatcttaaatatctctttcctaatgtctcatctttttatcagtcaacatcagggctaattccattaaacatatatacatagtacatgctctcatgtgtgtgggtatgcacacacacacacacagccatgtgaccctccattaaagtcctcctaaatattgtgacccatgttcaaagaggtgatattatttgcaagttgactattcctcctatttcatgtctatgtttggttatctttgccaggcagatggaatgagtttcagaggtgggacagggaataggaaatagagtttctgcatgaatgatggagagctttggtagtcagaatgattgaggaccagctattaaaatgttgttgttgttttccttcttggtctgttcctttttttttttcttttccaaattgtcttagagataattcccggctcacttagcattaggataatgacggttattctgtcccactgaagagtgttgaactggaacgcttccaccgggctttataggtacccagaatggcctaatgtttaacatatcctgcaggcatgcccctgagcacacactgcctttcctgcattcccccctctccatggtctaagccacatttctttcctggcatttatatttactgagaggtgaggggtgcattaggcccatttgatggatgaggacactagcggggatttgaaggaatgtctttctgggagtctccatgaattctctggagagttagctaacttaatgcaagttaagtgctagtctatgagaaaaatttctcagctgttttcatctttcaagctggcagtaaaaagccttttaagacagaaagattattatttgttatttggagatcctgttgttgggtctacaagtgcgtgaccatgttctccttggaatgttgagctatgcagaaatggagcactccaaagaacgatttgaccaatagcatttcttctctgggggttgtatttcaaagcatgcaactctccagggaaccagaactaaattgcttaaaatgaagtcattcctcagattaacttcctcagataaagtgtcagcggtctgcagaaacgaagaagacaaaactgagattatcactcataattctcttacttactatgtcagtgaaacaatgagtttgcatttttgcaatcctagaacattcttcattagccctgggtcatgacctcttccagttaattctctttcacacctttaggaaagatttaagatgaaccttcaataggatattaacataactcatagccaataccacagctgcctttcaaattaatgaggttaattgttctccagcaaacatgagtttgtctttggcattttaaatgcttcccattgatctgacattttgctgtttcaagttttaaagggctcaaatcaaagactattgataactgagcaaagagcgaagatccagaaatacgaaaacattgtctttttttttccatgaaaaacaatcatagccttttgaattcaatcgaagtttctacattagccatctaagacttatttaattatttctgttctcagtcaagctaattcaagtgaatgaacagtattgacttttaaaatcttttttaaatttttttaaatctttagtttattaagtttgtagaaaagctctggggccatgaccacttacgtaaatgtttcagtttaaaaacaaaagattcaggcctctaatttgagccaaatccaggtgatcttgtttgaaatttttgatgaatttgaaaagatgaaagtggaacttttaacattcatgttccccaaatttttcactgggaagggatgctaattgcctacttaagatataagttcaagaataacattttcatagaaaattcagaaaactgcttgacacagcagtgacatagttagatgtggctcagatgccttccaaacctgagggtccccaaagatttctttaccagttgtttttaactatgaatcttaatcttgttcattcccctgccaaaacaaatttaaaagcataaacctgctgaattaattggcagaattcaccatagtttatatcaccccagaatgtttatgtgtatatgtttatgtatagtatatatatttcaagctgaatgttcagaaagaataaggtgagtttcttggtagcttgaataagaattagatcataaaaattataaataatggccttctcaaagaggataaatgattcatttttcactcacgtattaataatatgacttgttgcataatacacaagctggtcattgcctgcaagaaagttattgaattaagcagctatccaggtttatgtctgagtccatttttaacccaacaaggctaggattgaactccatatgcagagggtttctattcacagctacattcaaacagaatccaaaacccacatcagaactgacttgatgtcttgtatggtggagctgaaagcaagctgtctgctctaagcaatggtcttcatttgggaattaatgttcactgatcaactgcagcagtttatatctgtcatgttttaatccactgcatgaggaagtgctaataagtgtattaaatatttccaagcatagctacaaaattatatgtttgcttaacacctttctatgatagaggaagtatatactatggttgtcttcttgtagtatgtcttttaattttgttcaatgtgttatcaactgttttaaggaatggggattgaaattcgtgtgcaaactgatatgtatataactcctgaggcaacagaagtgcccggtcatatggtgtaaaaatgtaaatacaggaaaatttcatttttctaataaagataatttctgccaattgatatgaaaatgagaaa

SEQ ID NO: 137502 - DNA, 13724 bp, Homo sapiens
  Payload ID: 6918
  Gene Symbol: GRIN2A
  Gene Name: glutamate receptor, ionotropic, N-methyl D-aspartate 2A
  ENST ID: ENST00000396575
  CDS Start-End: 1-3984
caggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacaggtaacccagccaccggggagcaggtctaccagcaggactgggcacagaacaatgcccttcaattacaaaagaacaagctaaggattagccgtcagcattcctacgataacattgtcgacaaacctagggagctagaccttagcaggccctcccggagcataagcctcaaggacagggaacggcttctggagggaaatttttacggcagcctgtttagtgtcccctcaagcaaactctcggggaaaaaaagctcccttttcccccaaggtctggaggacagcaagaggagcaagtctctcttgccagaccacacctccgataaccctttcctccactcccacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaacagttaagaatgcatctgcactgtagtgcgattgacatgtgcaagagattaggaagtttggctcgtaacagtttcagctttcttgttatgccttccatcacagcccaggctcaccccaagaactccaggctcccctaaagaatagcaaatcagtgtgttcgtgatgactgtgctaccttcattatagttcatttccaagacacatctggagccaaaggcccgagggaccctcaggtggggagagctacaggaatctctttggatgttgatgtgtgtttctctcaccctcggcttcgatggtcttgttcagagctgcataaactaacacatttatgtctccgagatctaagtgtggatcttctgtctgtgacacagtggccattgtagtttatcccgaagacgcctatgtacgtaagtttgcatttcctcccttctggtgatgactcagggttgtatagtatctgttaccccttccctcccagagtaaccataactcgttccgtttccaaacagccatggtggtgtccaattagctgtgtatcgctcttcccagagttgttaatgtggtgacatgcaccaacagccgtatgtgtactgtgatctgtaagaagtacaatgccatctgtctgccgaaggctagcatggttttaggtttatcttccttcacatccagaaattctgttggacactcacttccaccccaaactcctcaaatcaaaagccttcaaaacacgaggcactcttggatctaccctgagtatcctccaaactgtggatacagtttagtgagacaagcaatttctcccttctgagttattctctctgttggtggcaaaccacttcatagcaccaacagagatgtaggaaaaattcctcaaagtatttgtcatttctgagtcgcctgcattatcccattcttattctcctcaaacctgtgcatatatgacatgaaatgatatccattttttttttaagttagagacagagaggggaatacttatgcatggggagcctgttagcacagtgcctgccacaaaaacaagtgcccccgacaagatagttgctatgttatgacactttctcagatcaggattttctagtttaaaaattaaatatcataaaaccagcaaataatattaactaaaccttttatatagttctactctgttaattagtgtatttcatgtacatgaatatttttgaagtatttgggataactagccatcagtgtttgcagaagacctcagtctgttttgggccattacggaaacactaagctaatgtagactcgcctggccatttcctggtttcctcctgcattctgctttacattcttgaagaaagggataaagtggcaggttgaaaaattatcccatttcttctcctcatggtgtgcgttctgttttgtaagtattattttcttgcatgtgggcaagtgtcagggatgattcccttaaagctcaaggatgcatggaatagctccatctttgggaaagtacacctgacctacagtgttcctataatgaaaagtggttgcaataaatttcagggtcaatcatagggagacagagggaggcagtgggtgagaggagcttcctttcatttttgaaaggcagaaggggctgactaggtgctggggatgcatgtgcttgaaaatgacattttatttcccggatgctgtacctctgctgccccaagacccagccatggagaagcctggatcgaagggcccagaatagtcaccccaacatctgatcctaaatctgaatctccatgactgtgtagccttttagccctttctaccttctgcccttccagtgcattccagaccttaatccaccccagcaaggatcgcctccatttcctcatgagtctgggatgttttgacatgaatgaattaaaaagtcttcccagaatacagaagagtgatttgtcgtcaagccaaagaggctttctgtcttcctctggtgtcctctaaacccagggggctgccaaatgccacagagacctccagggagagtgagagttatacttggactgacttcatcggtcagaaagccttcccctaacagcagcattatttctgctattaaccccatacatctctggataaagaaactgaaaacgtggcctttggaagaatcaacagtaatgttgtgaaaaaaatatatattcttttcactgaccgaagtgttttttcaaataaataatcagaaatgttatgctacacaaagtttatggtatcccttctctactaattcaatgactcttcaatgtgatgatcccaagcaaaaaaaaaaaaaaaaaaaaaaaatcaactactgatcagatggtcaatttctaaggaaaagatgtagagttattcaaaggtcatctaagtcagttcagtctttgcaaaaagaatatcaggaatgtaacgtccagtggtaaatggaacccacagtatgagaagtaacaagaattaaataggaagcctggaagcctgagactatagatctatcacagaagattcccgtaacatatcccagctctgagttcttagatttgttgatgtcaaggagcccaaatttctgaacacaaatgcctgagtttcagctggcttaagtcagagctggcatccataatgatattttgttaattctaattggttttccccacttgagaaggacccaactagtcctcagataggtacacttgaatgcaaacggttgggtctctgtccatgggtaatagcacgcacatgcaaccaatttaaaatactctgggtaagagagtcttctagagcataaactgtacttgagaaacctttgtgcttctggaaaatgggtttcatcatccttacatctgcaggttcttaggccacttatggtttcaatgctctgagctggcaagtccctataggtctatctttctgccagagagacttgcaggattataatctcacaatctcaccactcattactgttatgtcctctgcaaatctctctgcgttattttagccagcaccatgactgggcatccacggattactcttgattttctcttccctgattcacaggatgccagagagtctgagtatttagtttttctggtgaaagcattaaaattcacacattgcagcaaaatctgtcaaatcatttcacgcttattttctggggagaaaaatagaaaattacaccttgtttacaaatgaaatagtttcacttaaatgggactctagccaaggcagttaattagtcaaaagatccacagctgtcatatagtcacacattgtttattctatttgctatgtcgaccactgatgtgtatttaatattctgcatccttcacaggaaatgacaaatgccctgaattatttgcaaatagaattgctaatgaaaaagaaaaaaaatgttgatgttaattaaatggtgattaaaaatttatctcctttaaatctaaaaagtgcagctttaataatcagttgtcatataaataagtaccttgtactgaaatcccttgcggtttaagacctaaataaacactaatttgagaactctaaataccttacagaggagctggatatattcgttaacattatgcacattcctgtactgtttctttgtgcatagctgttgtgcatgaatccttgaaaaggggacatgcgttgtttctgaaatggagcctgtttgtattaaccatggctatagtagacatgattggactcaaagaaaaagaagtttgagtaggtggaagctaaatgtgttgcttgatatttaatgagtgaagggttctatgtaaaggcaattttccttccaaaagtactgtttattttcactggagacaaaattagacctttccagataccccatctctttttggtgaacagggttgaaagtgctgtggggtctatacttgaaaagttctcccaatatgcagttactgtttcccattcaatccctatacattgtactgtgttcatatctaattgtatcagatgaggtcagcttgccacttgatatagatcagagatgatcaaatgcacttatcctgtgaatacaactgcttgtgtacacatgtatataatatacatgcttgatttctacaattcacacgtaagtgtattatccaaataaaattgtacatattgtaaagtttatgttaaaaattaaatggtgatgatggtattaacacatggaaaacccattctggttatttttatgggaggatatttctgtagagagggcactatatttttttaatctcagttgtagggaggatgacagagcctaagtagaatatgggtgttggcgttcttggccccttctttaaaaaacaaaactctgggatgaggggtatagaatatattctgctcgcatttgcttctgaagacaatgccgatatggacttgtgtgtgatttccttaaacacatcaaagggcatagatttcctatttaaattccttatcctctttcctcacctgcactctttctgtgcccagcagtactttcagtatagtattagctagaagtgcctgcccagaagggtcttagaaaaatagagttcgtagaaccacaccaaaagttaggagaaggggaggagagatgagaaaaatgaagtttacaaatgggcagttgcctgtttaagatcatcaagttagagagtatcagagcgaggattagatccaagacatggttcaatttctggctcgattctctgaccgggctgacttatttctaggtttctttcaaggggaaactcctgagtagctctggaataagagccagagatccccataaggctgccctggtttttgttttgttttgttttttgtttttgccacttgccccagaaagacctacccatgcttctttgaatttggttttcctttaaactccctcacaatccctgtcttaaagttcctagaagagaaaacttttctcagagaccgtctccttaggaaaaatcaacagggatattgtttaaaacctcaaactgaagataaaaggctggcagtgaccattgaaataattgaggtctatgtatcatgcattgaggaagaaccaagcacattgaccagctaataggacttcactgaatgtccactttattttgaaagccagtttgggattgtgggggaggggatgcaaaataaatagaaaatatagtctcttcccataagtagcttatggtttagaagttcagttctctaatacaaaggataaccaaggacccatgcaatgcaaacagagactaaacagcaaaaattagaaatgacaactaaagttgtagccaggaaaaaaaaaataatctgattctatgagcataccttttttaaaaaaaaaaaaaaagtccttccctaaacctttaagtaactccggagaatagagttagtggtcccggaaatgcagttgatttattttaatcttcaaataatggacttaggagacccaggagctgctaaccaggtgaacacactcacactcctacatttttgcacaggaaggcttttgtctggttccaaccagttctccagtccttgccaaatcatgcctcctcccagccttgcattatgacatgtgcctcaagaaaaggttgaaaaaattccccaaaggattagaaaatagaccatgatgtaaaaagacgaagcatttccctaaagcttttttgtttggttttgtttttgacatttgaagaacccttctgatacaccagggtatgaatgtatcagggaagcatagagggaaaattctttatcaagttccaagtgcctactgctgtggctgacagaaagcatcaggttccctagagagaaaacggggcaaagagatggcaaaaggaatagaggtgtatttcaggaaggatggcgaggtggagagggagcttttgtcactctgtctatcccattctgtgcattcttggaatgttacattttctgcttatcgcaagtacttgccatggatctgcacctgaatttgaaaatatcaaaatatatctaaattgagtgtaggcgatattctaggcatatcctagaatgtgatcctcaaaacaaccttaagatataaatatgattgctcccattttacagataaggaaactgaggctcaggtttttctcaacctcgtcagcaactagaattagctagtaaatccctaacgttagacatattttcaaagtgcctggtctcctccagggaggtcagaatagaagtcagaaagagaggtgtgctcttttgaggttcctgggcatatacccttgagtatcagcctctgtgacagggaagtctgttagggtcttacccctcattgcctgatctgtgtgtatggagaacttctggggatctcacctctgttcatagttccttctgagacttgaacactgtttgtgtctccctttcatatgcttgcacttagcatttaaaaaaatttctggggagttattttctctacttagcatgtgcctaatcttaaatatctctttcctaatgtctcatctttttatcagtcaacatcagggctaattccattaaacatatatacatagtacatgctctcatgtgtgtgggtatgcacacacacacacacagccatgtgaccctccattaaagtcctcctaaatattgtgacccatgttcaaagaggtgatattatttgcaagttgactattcctcctatttcatgtctatgtttggttatctttgccaggcagatggaatgagtttcagaggtgggacagggaataggaaatagagtttctgcatgaatgatggagagctttggtagtcagaatgattgaggaccagctattaaaatgttgttgttgttttccttcttggtctgttcctttttttttttcttttccaaattgtcttagagataattcccggctcacttagcattaggataatgacggttattctgtcccactgaagagtgttgaactggaacgcttccaccgggctttataggtacccagaatggcctaatgtttaacatatcctgcaggcatgcccctgagcacacactgcctttcctgcattcccccctctccatggtctaagccacatttctttcctggcatttatatttactgagaggtgaggggtgcattaggcccatttgatggatgaggacactagcggggatttgaaggaatgtctttctgggagtctccatgaattctctggagagttagctaacttaatgcaagttaagtgctagtctatgagaaaaatttctcagctgttttcatctttcaagctggcagtaaaaagccttttaagacagaaagattattatttgttatttggagatcctgttgttgggtctacaagtgcgtgaccatgttctccttggaatgttgagctatgcagaaatggagcactccaaagaacgatttgaccaatagcatttcttctctgggggttgtatttcaaagcatgcaactctccagggaaccagaactaaattgcttaaaatgaagtcattcctcagattaacttcctcagataaagtgtcagcggtctgcagaaacgaagaagacaaaactgagattatcactcataattctcttacttactatgtcagtgaaacaatgagtttgcatttttgcaatcctagaacattcttcattagccctgggtcatgacctcttccagttaattctctttcacacctttaggaaagatttaagatgaaccttcaataggatattaacataactcatagccaataccacagctgcctttcaaattaatgaggttaattgttctccagcaaacatgagtttgtctttggcattttaaatgcttcccattgatctgacattttgctgtttcaagttttaaagggctcaaatcaaagactattgataactgagcaaagagcgaagatccagaaatacgaaaacattgtctttttttttccatgaaaaacaatcatagccttttgaattcaatcgaagtttctacattagccatctaagacttatttaattatttctgttctcagtcaagctaattcaagtgaatgaacagtattgacttttaaaatcttttttaaatttttttaaatctttagtttattaagtttgtagaaaagctctggggccatgaccacttacgtaaatgtttcagtttaaaaacaaaagattcaggcctctaatttgagccaaatccaggtgatcttgtttgaaatttttgatgaatttgaaaagatgaaagtggaacttttaacattcatgttccccaaatttttcactgggaagggatgctaattgcctacttaagatataagttcaagaataacattttcatagaaaattcagaaaactgcttgacacagcagtgacatagttagatgtggctcagatgccttccaaacctgagggtccccaaagatttctttaccagttgtttttaactatgaatcttaatcttgttcattcccctgccaaaacaaatttaaaagcataaacctgctgaattaattggcagaattcaccatagtttatatcaccccagaatgtttatgtgtatatgtttatgtatagtatatatatttcaagctgaatgttcagaaagaataaggtgagtttcttggtagcttgaataagaattagatcataaaaattataaataatggccttctcaaagaggataaatgattcatttttcactcacgtattaataatatgacttgttgcataatacacaagctggtcattgcctgcaagaaagttattgaattaagcagctatccaggtttatgtctgagtccatttttaacccaacaaggctaggattgaactccatatgcagagggtttctattcacagctacattcaaacagaatccaaaacccacatcagaactgacttgatgtcttgtatggtggagctgaaagcaagctgtctgctctaagcaatggtcttcatttgggaattaatgttcactgatcaactgcagcagtttatatctgtcatgttttaatccactgcatgaggaagtgctaataagtgtattaaatatttccaagcatagctacaaaattatatgtttgcttaacacctttctatgatagaggaagtatatactatggttgtcttcttgtagtatgtcttttaattttgttcaatgtgttatcaactgttttaaggaatggggattgaaattcgtgtgcaaactgatatgtatataactcctgaggcaacagaagtgcccggtcatatggtgtaaaaatgtaaatacaggaaaatttcatttttctaataaagataatttctgccaattgatatgaaaatg

SEQ ID NO: 137503 - DNA, 4118 bp, Homo sapiens
  Payload ID: 6918
  Gene Symbol: GRIN2A
  Gene Name: glutamate receptor, ionotropic, N-methyl D-aspartate 2A
  ENST ID: ENST00000535259
  CDS Start-End: 5-3439
ctggcaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaacagttaagaatgc

SEQ ID NO: 137504 - DNA, 4338 bp, Homo sapiens
  Payload ID: 6918
  Gene Symbol: GRIN2A
  Gene Name: glutamate receptor, ionotropic, N-methyl D-aspartate 2A
  Uniprot ID: Q12879
  ENST ID: ENST00000562109
  CDS Start-End: 30-3875
tcgggctacagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagg

SEQ ID NO: 137505 - DNA, 30355 bp, Homo sapiens
  Payload ID: 6919
  Gene Symbol: GRIN2B
  Gene Name: glutamate receptor, ionotropic, N-methyl D-aspartate 2B
  Uniprot ID: Q13224
  ENST ID: ENST00000609686
  CDS Start-End: 455-4909
cccttaggaaggggacgctttgggaatgaccatgctccaccgagggacggagccggcccccagcttctccacacagagcctcctccactaacgctccaaaaaccaaaaaccgtaattgccagaagaagcgttaaaaatctattccagccactaacctcacatgcacacggaataattactctggattctgcattgtgagctgctctccataccctgaattacctttgaattaaatctttttttttttgaatttgcatctcttcaagacacaagattaaaacaaaatttacgctaaattggattttaaattatcttccgttcatttatccttcgtctttcttatgtggatatgcaagcgagaagaagggactggacattcccaacatgctcactcccttaatctgtccgtctagaggtttggcttctacaaaccaagggagtcgacgagttgaagatgaagcccagagcggagtgctgttctcccaagttctggttggtgttggccgtcctggccgtgtcaggcagcagagctcgttctcagaagagcccccccagcattggcattgctgtcatcctcgtgggcacttccgacgaggtggccatcaaggatgcccacgagaaagatgatttccaccatctctccgtggtaccccgggtggaactggtagccatgaatgagaccgacccaaagagcatcatcacccgcatctgtgatctcatgtctgaccggaagatccagggggtggtgtttgctgatgacacagaccaggaagccatcgcccagatcctcgatttcatttcagcacagactctcacccccatcctgggcatccacgggggctcctctatgataatggcagataaggatgaatcctccatgttcttccagtttggcccatcaattgaacagcaagcttccgtaatgctcaacatcatggaagaatatgactggtacatcttttctatcgtcaccacctatttccctggctaccaggactttgtaaacaagatccgcagcaccattgagaatagctttgtgggctgggagctagaggaggtcctcctactggacatgtccctggacgatggagattctaagatccagaatcagctcaagaaacttcaaagccccatcattcttctttactgtaccaaggaagaagccacctacatctttgaagtggccaactcagtagggctgactggctatggctacacgtggatcgtgcccagtctggtggcaggggatacagacacagtgcctgcggagttccccactgggctcatctctgtatcatatgatgaatgggactatggcctccccgccagagtgagagatggaattgccataatcaccactgctgcttctgacatgctgtctgagcacagcttcatccctgagcccaaaagcagttgttacaacacccacgagaagagaatctaccagtccaatatgctaaataggtatctgatcaatgtcacttttgaggggaggaatttgtccttcagtgaagatggctaccagatgcacccgaaactggtgataattcttctgaacaaggagaggaagtgggaaagggtggggaagtggaaagacaagtccctgcagatgaagtactatgtgtggccccgaatgtgtccagagactgaagagcaggaggatgaccatctgagcattgtgaccctggaggaggcaccatttgtcattgtggaaagtgtggaccctctgagtggaacctgcatgaggaacacagtcccctgccaaaaacgcatagtcactgagaataaaacagacgaggagccgggttacatcaaaaaatgctgcaaggggttctgtattgacatccttaagaaaatttctaaatctgtgaagttcacctatgacctttacctggttaccaatggcaagcatgggaagaaaatcaatggaacctggaatggtatgattggagaggtggtcatgaagagggcctacatggcagtgggctcactcaccatcaatgaggaacgatcggaggtggtcgacttctctgtgcccttcatagagacaggcatcagtgtcatggtgtcacgcagcaatgggactgtctcaccttctgccttcttagagccattcagcgctgacgtatgggtgatgatgtttgtgatgctgctcatcgtctcagccgtggctgtctttgtctttgagtacttcagccctgtgggttataacaggtgcctcgctgatggcagagagcctggtggaccctctttcaccatcggcaaagctatttggttgctctggggtctggtgtttaacaactccgtacctgtgcagaacccaaaggggaccacctccaagatcatggtgtcagtgtgggccttctttgctgtcatcttcctggccagctacactgccaacttagctgccttcatgatccaagaggaatatgtggaccaggtttctggcctgagcgacaaaaagttccagagacctaatgacttctcaccccctttccgctttgggaccgtgcccaacggcagcacagagagaaatattcgcaataactatgcagaaatgcatgcctacatgggaaagttcaaccagaggggtgtagatgatgcattgctctccctgaaaacagggaaactggatgccttcatctatgatgcagcagtgctgaactatatggcaggcagagatgaaggctgcaagctggtgaccattggcagtgggaaggtctttgcttccactggctatggcattgccatccaaaaagattctgggtggaagcgccaggtggaccttgctatcctgcagctctttggagatggggagatggaagaactggaagctctctggctcactggcatttgtcacaatgagaagaatgaggtcatgagcagccagctggacattgacaacatggcaggggtcttctacatgttgggggcggccatggctctcagcctcatcaccttcatctgcgaacaccttttctattggcagttccgacattgctttatgggtgtctgttctggcaagcctggcatggtcttctccatcagcagaggtatctacagctgcatccatggggtggcgatcgaggagcgccagtctgtaatgaactcccccaccgcaaccatgaacaacacacactccaacatcctgcgcctgctgcgcacggccaagaacatggctaacctgtctggtgtgaatggctcaccgcagagcgccctggacttcatccgacgggagtcatccgtctatgacatctcagagcaccgccgcagcttcacgcattctgactgcaaatcctacaacaacccgccctgtgaggagaacctcttcagtgactacatcagtgaggtagagagaacgttcgggaacctgcagctgaaggacagcaacgtgtaccaagatcactaccaccatcaccaccggccccatagtattggcagtgccagctccatcgatgggctctacgactgtgacaacccacccttcaccacccagtccaggtccatcagcaagaagcccctggacatcggcctcccctcctccaagcacagccagctcagtgacctgtacggcaaattctccttcaagagcgaccgctacagtggccacgacgacttgatccgctccgatgtctctgacatctcaacccacaccgtcacctatgggaacatcgagggcaatgccgccaagaggcgtaagcagcaatataaggacagcctgaagaagcggcctgcctcggccaagtcccgcagggagtttgacgagatcgagctggcctaccgtcgccgaccgccccgctcccctgaccacaagcgctacttcagggacaaggaagggctacgggacttctacctggaccagttccgaacaaaggagaactcaccccactgggagcacgtagacctgaccgacatctacaaggagcggagtgatgactttaagcgcgactccgtcagcggaggagggccctgtaccaacaggtctcacatcaagcacgggacgggcgacaaacacggcgtggtcagcggggtacctgcaccttgggagaagaacctgaccaacgtggagtgggaggaccggtccgggggcaacttctgccgcagctgtccctccaagctgcacaactactccacgacggtgacgggtcagaactcgggcaggcaggcgtgcatccggtgtgaggcttgcaagaaagcaggcaacctgtatgacatcagtgaggacaactccctgcaggaactggaccagccggctgccccagtggcggtgacgtcaaacgcctccaccactaagtaccctcagagcccgactaattccaaggcccagaagaagaaccggaacaaactgcgccggcagcactcctacgacaccttcgtggacctgcagaaggaagaagccgccctggccccgcgcagcgtaagcctgaaagacaagggccgattcatggatgggagcccctacgcccacatgtttgagatgtcagctggcgagagcacctttgccaacaacaagtcctcagtgcccactgccggacatcaccaccacaacaaccccggcggcgggtacatgctcagcaagtcgctctaccctgaccgggtcacgcaaaaccctttcatccccacttttggggacgaccagtgcttgctccatggcagcaaatcctacttcttcaggcagcccacggtggcgggggcgtcgaaagccaggccggacttccgggcccttgtcaccaacaagccggtggtctcggcccttcatggggccgtgccagcccgtttccagaaggacatctgtatagggaaccagtccaacccctgtgtgcctaacaacaaaaaccccagggctttcaatggctccagcaatgggcatgtttatgagaaactttctagtattgagtctgatgtctgagtgagggaacagagaggttaaggtgggtacgggagggtaaggctgtgggtcgcgtgatgcgcatgtcacggagggtgacgggggtgaacttggttcccatttgctcctttcttgttttaatttatttatgggatcctggagttctggttcctactgggggcaaccctggtgaccagcaccatctctcctccttttcacagttctctccttcttccccccgctgtcagccattcctgttcccatgagatgatgccatgggccctctcagcaggggagggtagagcggagaaaggaagggctgcatgcgggcttcctcctggtgtggaagagctccttgatatcctctttgagtgaagctgggagaaccaaaaagaggctatgtgagcacaaaggtagcttttcccaaactgatcttttcatttaggtgaggaagcaaaagcatctatgtgagaccatttagcacactgcttgtgaaaggaaagaggctctggctaaattcatgctgcttagatgacatctgtctaggaatcatgtgccaagcagaggttgggaggccatttgtgtttatatataagccaaaaaatgcttgcttcaaccccatgagactcgatagtggtggtgaacagaacaaaaggtcattggtggcagagtggattcttgaacaaactggaaagtacgttatgatagtgtcccacggtgccttggggacaagagcaggtggattgtgcgtgcatgtgtgttcatgcacacttgcacccatgtgtagtcaggtgcctcaagagaaggcaaccttgactctttctattgtttctttcaatatccccaagcagtgtgattgtttggcttatatacagacagagatggccatgtattacctgaattttggctgtgtctcccttcatccttctggaataaggagaatgaaaattcttgataaagaagattctgtggtctaaacaaaaaaaggcggtgagcaatcctgcaagaacaaggtacataaacaagtcctcagtggttggcaattgtttcaaccagtttgaaccaagaactttccaggaaggctaaagggaaaccgaattttcacagccatgattcttttgcccacacttgggagcaaaagattctacaaagctcttttgagcatttagactctcgactggccaaggtttggggaagaacgaagccacctttgaagaagtaaggagtcgtgtatggtagggtaagtgagagagggggatgtttccaatgctttgatcccttcttacttaacctgaagctagacgagcaggcttcttccccccaaaactgattacaactgctacagagcagacagttaagagaaatgagcttgacctttaagagaaatgagctgcactccatgagtgcagctctggaggtacgaaaagaggggaagagacttggaaatgggagacgggggcagagagggaccctccaccacctctttgggcctggctccctgggaatgtgacttgagcccagagtgaacactcttggtagaagcccttctaccttcctgcaacaccttgtttccctctcagattgtaccattgaggaataaaaaaagatatacatgtataaaactccagggatgagggtaccagcagaactgatgctcccttcacttaacattggaaaattgagaagggaaatgaatatgtatcactgccggtcctgaaacttgcggtagggctatttattctatgggtcagttccactgtcctgccatcctcccctacacagggtggcatccagagagccccaggtctgtgtggaagcttgactgcaggatcgccatgttgcacacaggacacataaaccagaaaggtgctcatcctcctctggaaggaagctgccatgtctcttcaagtcactccctccagggctgctcttcgcccctgtttgccctcactcgtgacccttcctcatcccgcccttgactgctgtccccaaccctcctccttgatttttacctcagtatctttcattttaaagccaactgaaggccttgtaaagctttgttttctttctaaaatgaacatgggggcaaggggctgaacctctcacagatttggtgagaggagcacggagtgctttaccttagataacagaaaagactgagagaggacagagggcatgaggcacctccaggaggaagaaggcgaagggccacgtaaacactgcttcgccctgactctgtccaggggtcagggactcatcccctcatcttcctcttacctcacccctttcaaacaaaaaaaccaaaccaactaacctagcgaacagcaatctagaaccaagggagctctttcagtctccgctggcaacagaaatcaagatggtgtttatttcatatgtaaatattttgttttctaattttgtatagataaagtgttctcttgtgagtattcagggtgttgggctggagggagtggggtggtgatgggaatgagagggaaaaagtgttttgttatgggttttcatttcccattgggggaattgttttgtatggcttttttgcttcagggtgtctggaaaaagcgaatgctcatggaggccactatggtgaaaaagccaggggaaagtaattgtgtccatcccccccagaaaaccagtcttcttactggtttgtgagaaatgttcatgcactttggccagggttttacatagggttcaatttggctctaagcaaaccccaggtctgactcctatcttctaggtagaccctaggttaccacattccacacaaagacaggctggtggcaccatatttcctctgtcagtacctagggtaggaaagattcccaaaagggcttaaacagaattaaggtcaaattaacttcccattcttggcgtgactgaaaggtttcaggaagctcaatcctgagaaatctcccagcggcctcctctgatgctgaaacaatcgtctcagtcatctgagtcttttcttctttaggacctgggcgctgactcactccctgccccatctccaccctcagaagtcagcctggcaaacacacgtggaaaaatctccactaactctactttttgaagcatgtgatatctggtcacagagaggtagtgctggatatgtgtcttacaaatttgcatgcttttctagaaaagatgatgggatccactagaaactcagtggtgagatgattcccttagcaagattgctgaagttaggtttagacgtgggagggtgggtatgtgagcaatggtgccaatagcggctctttatttgccttgtcctcattactgccatcaggaaggtgctactggcctcgagccaggtgttcataatctggccttgggttaaccagacaaatagaacttcttttcctagactgttggctttgtggaggttggcagcctctatcacaggataaaatttccaaatccatttacccagtatattcactacattttttcctatcctcccatcataaaagctgttagctggacaattttatttttctaaacttatttggccccagttggttgcttttcttcaactggatatttgcactgggactaagttactcatggtctgcttaagaaaacttaaagaaaggaaggctgggcattgttaaaatctagatgttacttaattccagaataacaagcaagtaaaatgcatgaggaagaattcagctataagcccaatctatatcacagatgggtatgaaacaacacccaatccatccaaaactgtgagattccgcagataccctcaggagcacctaatattcccatgttcttcagaatccatgctttctcgctttgtaccctctatcattcccttccattgcagaagtggttggtgagtgtggtcctgtatgaactcctttcagtggcaatgcttaaatctcagcatttccactgacaataatctgacccttgaatttgcctgagtcgagactttgcacacccttcaaagtgatgcatgtacagtggactttgttatttcaaaatctgtcactgtgtatcctcagccagaacttgggaaacatccttcatatgtatttccctgcactggccacagccatgttgtgattgaggggaaaatcccaaatgattccattaaatgttgctggtgtcagtagtgccaaaaacgcatgtatgacatgatacagtaggagttgtctatacagttaagtgactatcactcacccggtcttccgtggccatcaggagttgcccaagggagaattctctgcagagtgctggtcacctgcacatgtcactaagaactaggtttctttggttcattttttttttttttttggtcggtttttagttagttagttcaagatttacagatagaataaccagattgtttgggcaataagcttttggaaaaactattccagaactcactttattctttcaatcatcatctctctaaaaaggccctgtcattgcttgacaccctgtgaatgtctgtttttgtatgttaggaatgattcagatgtgtgcataaatgatgtcactgcagtgatattgatgaatgcattcagcatttccagggactgtggccataccttatgtgctctctgagcccaaagccatataggaaatacatgctcagtaggctgctacacactacagcagagcttttgctttcttcacttgggtgtcagagacttttcctcctgtttaaggagctcttcatggaggagaagcagctgaaagtgaatagtcacactgggatgggtctggccttatgtatgctatgtggtccatggtgtgttgaaggtcctgaaaaggtctttttcatttcccaccccactgcaactaccaccttcccacacagatttgttgctttagcactgagctgagctgtctgtcattcgaatgaaagtaatcccaggaaaggtgacatattaagccatattagggatgtatacatttaatcacctaatttacattaggaatctcactccttttcctgggaataagttatgatacaagagaagaggaagggagcagagagcactgagagcaatagagtagggaacaaggatacaggttctagatggcaaagacatttaaaccatattttggcctccgcctgcttttatttaagcctcatttgacacctaaataggactcctggttaggaattattttcaatacacaatcatatgagtgtataatttatgaatttctaaattcagtatcttgtagggcaggttgagaactatgattctttccatagaaaatagaagagtgatgcttctcctccattacatgttactgagtaggcagctagaaaaatcaaattgaattagtgatacaataaaatttactgtcattgtctggtttctgtcccagtttaattaatcttccaattagctgagttggtctatatcctatactttccacctccatagggggtgccctgttatctggtaaaagagccacttatgacctcaggtgctacttaacctggggggcaattgtttcttaggcctagcagatgtttgggatgacactaaaatggcagattagtcagtctgagaatgtctaatattgatctgaatctaggattctattctagtttggggggtggggttgcagtattgtataaaatcataggatatctgagaacatcccaccctcaactcattccaaccacattgattcagtcacacagtggccctgtgagctctatgacttagaagagatagcctatctattcctatgacaaaggccctcacccaaaaccttaaattgaaagccagtgctgctactttcatgccttggagagaactgtgacgtttagggcttctcatttacaatattgaagcaagaaaaaagaattttgttcagagtaatgggttagaatagcagtactgggaataagtagggaaagttagaaatcttccacatttctctctacatctctcaagagctctgtacagtgagtttctggagctgcttcatgctttgaatataattgctggggtgattatgtggttaagggctcctgaaagaactgaaggtgaaaagcagagtagatgagtagaattcctcagagccttggcactctggtgtgtagaatctgtgttttggagaaggtgaaagaactcagtgcaagaattaaggtacaattaaaaagcacaacactaagcccaatttaaactgttattttaaagattaggtttccacactttaaacctgaactcttttatcggtaattattttaatgttgtgatttaggaggtggagcagattctagtactatgcaggagaaaaaaataaaagctctctggttaaatatgtgagtttaattaaaccaacgtctattgtgcacgtactatgtccctaggctagttctgtgaatgatataaaaggtttcaaaatggagtatattgtactcacgtagaatatatgaaagcataagtataaaatatgtaaatgtatgtataaataggtatgcatacatttgtatgattatacatgcaagtttaatattttctggtttcagggtaggagtcaaagatatccattatgctatttgaaaaaacattgcagagattcagcttcccatgtcatggccaggcctggacttattcttttgaaattattacacctcccagagctaaaactctgggatttcctctctaaccacaaccttgccttttctatatcttccttccttcaagacccctctgttgttctggtccataaatccatcaggcctcattgaattccctctttggtctaaccctgtatttacccacattagcaatattctcaccggcaattcctttttcctcttgccatctcactacaccaaccatgcttagctaactgcatcccatccccttgtcattcattgcatccccaagaagagcaagtcttaaacctacgtgaagagcacaaattcaatcaatttaacctcacctgaagcctactcacttggactttttaatttctccaatgttgactcagtgtcacattctgtgcttgataaatttgttttattttcctttcatgttcatgtcctgtctttcaacaggcaatctttcctactgtgtttgcaagaaaatctgattattgaatcctcacatatgctgtcctctctgcctttagatttctcttgtctttcacacatcttttccatcctttctcccaaccaagtgctcctcttccctatgctctgacctcttctgaggtgctctccagccaattgtatttctctcttttgcatctttaattccttccacacatctacctgcaactatctcaaaaacacccgtcctacaactatctctaaagacaaatctctcaatccaatttgactcttgaatttctgtcctatcgctatcttttcacttcccaacttctcaaaagggtagtctttctttctccacttcctcaccttatgctcatggcttcatcaatgggctacaccctaccactcttctgaaactactctcaggcaacgttccaatgaagttcttgttacaaaagtcaatagccttttttctttacttaccctgctcttcaacctcattgacaattaccattgggaggcaatacattctggttttaatcttagttctctggtcctctaacctcattggttcctgctcttcctcttatctccttagcattgacttgccatggtatatctgagcttgaccctcttctccttatcttaatgcttctgtagcaatctttctgtcttctatgatttcaataactctttgaatgaagatgaatcccaaatcttcacttttagcccctaccttttgcttttccttcatacacatacttccagtcaccttctgaacactcaacttcatcttgactcaaatatccaaaaccattgctgcaaaccaacataatcaccaacttcctccttttgcttaatggtatcaccatgtcttccgtcaccgaactcaagcttttcaggcacttttgcctcctccattttcttcatcctgcatatctaaaaatttgaaaagcctactaattcttccccctaaggtttccagtctttccttttcattcagacccttccttctagtctggattatttcagcgtcttttagcattgttccaatattttatatttgaatctactcttgtcagtactcacttcctacatataaatcagatgtcattcttcagatcaagaaacaaccttcagtgggcttcacttgccgtagtctgccagcaataatttcttgttacttgactatgtgtgtgtcccataatccagacaagctgaataacatttgtttcacctttccctaccagcttgttttcccacttgcgtcttcccttaaactgttccctttgtccaaaatactctccttcctatctcccatctcactcccttcttgaataatatccattccctctatataagtcttcaaagaccagaacaacttctttatcttccattcagaaaataattttaggcattttatgaatgcccataacactttcgttgtttctccctagtggcagctatcatgggccatcttatttcataggtatttggttatacatctcatctctcctgctacagcataagctccctgtgttcagggccatgtatttttaaatctttttatctcctgtagcactaaacagagtgccttgtatatgaaaggcattagtaaatatttgatattattataaattataattgagaaggagtcactttattttgcccatttgtatctgcagtagcacctaaggatgaatccccccagtttctctatatatatctgcacacacaatcacatgtatatactacatgtatacagttcattatttcaaatggaatctggatttttctaagtgctttgtcctttttctaagtgctttgtcctttgaagttgttttggactgttttatggttaggaaagtgtacttggaacactacatgtgttcaagtaagtgacagagggagaaactatgaaggatattgatcaaattttaggtatcagcttttcagatgctttgggtagagcttgtatccagacactttactaccaagattgagtctctaataacctgatccatgctgggactgatctgtgatccaatatttagcttcttttttaacactttcagcaccaaaagaaccttgtcacagttctggctcactaatcacacagccttgtagaccccaggtggtggtccaacaggaccactgtatttcaccacacgctacttccacatttgtggccttgggggaactgtctgtgctggtcaccaccttgtctttatatttctttcctgagttctttggcttctcaccctttctgaggctttgtctacaggatcacttctcccaaagggaggataagagttgaggtaattgagcactttacctcttatctgtatatttacaatgaaagtaagttaggatttgaatgagctggctcagagagaatgctagtctctaaactactcctttctctgtaaatataaagggattcattacctcagggggagacaacatcacttctgaccttatggccctcccttatcctctggtccctgtattcttgaagccctgttaacccttcctcctcctctcttggctctacttagcaatctatcaatcattctttctagccagtgtcagtctctgtccctctgaagaaactcttggagctcgtactgtcctttcacttcagctgctctggtaaccgataatgttttcgttccttctcccggccagccttctctgtaaatctcattatgccattggctatgaattattcccctttgggaggcatcttctgccactgtgtgctaatttaaagcatactatagagaactgaactcaaataagttacaggcagtgacaagtctctttttttaaaaaaaaagtgaagaaagtccactcttcattgagacaggagtgggtaggacaattattattggcaaggtagggcaaaacttgtgacaacttgggagatacctagtgaaaattaaaatataagtctagagagataattttgcttttcaaaagtcctatggggtctagatagccttgctcctgaaaatgagaatagttaatattttagagcaaaacccatttcattatactatgagacttttttttttagctgatgaaacaaattatctggtaaacagctggtgggagggtaggaagacagccatcctcatgaaggacgttcatgaatctcatttgggccaataaatggaccaaaattctaggcattttagccatgaactgttcatgtcaattattttgcctacaaatacccataaaaggaaagggaggatatgaggaaggaaaagaacaggaagtctacactggagcttccttttgtgtcaccaataaagccagaagctgacatgtgaggcacatggttcccccttggttactggcttcaatgatagcttcggaaagtagggaaacttgaaagagcaaggaccaaagcggagatgagtgaggaacctgaatgcaaccttatgtgtgaggtcctgatatccacaaggaacctggccccatgtcattcctgcccaggtccttcagattacagcacccaaggagcccttgatcatcaccctgggcagagggagtgacttatcacaccacccttacccacagaatttaggccaccaggctgtgactccatctgtcccccttgcagtaagagattcatagtctctgaaatctgacaggagaacagcatcaggggaaggggccacaggaatgcgaatttgttgagctgcctgctcctctaggataagtatattacctgtttccagaggggattgtttttttttcgaaatgaaacaaaacatgcctgcctaaaacttcagccctattcagaacagtcttgcagttaactgtcattgtcacattttaattgtaattgattttcttttgaaatccatggctattttaatgctccctttgaccatgacataagaaccctctgcaaaccagagacctggccattaggttgcctctggctgagttatactctcagtagtttatactttgctctcagatattcacctgaacagcacaactacacagaatttgatctctttgccatgagcattctgatgcctatgtacctccctaatgcacacacacaatcttaacaaatagatccaaatttcctatgtcaatcatgttatggtagatgaaagtgttcatttagaatgggataaagagacatatcataatttatgcagccagtgttttctctttgctctacctggcttgtggatcattgatccctcaaggtttgacagaaatattcaggcttcatgtgaaggcagcatgttctttgtgatgaaacaacctagttatcgtctccattttcccattttaccctatggaatccatgtggccttctaaggtcctgttgatggactggtactaagaggatggagaagcagaagccagtccccctgagaacagacagtcctgttgcttagatacatacatattcgcacatgtgcccacatctcttcttggaaacatcatgagcagaggtggagaggtctgttctcaatgggaggaataagggtaggagaattccttgagaatccctattctcaaggaatagggataaatgccttcacggattcaataatttatctgttctctctctcccagggtcaggagcaagaaaaatatcaaggtttcacataggcaggaagcaaggaggatagtgaagcatctaggtggaggtggaactcttactgagaaaaacatgaagtagtaaaatcaccctttctttgatataaatgcatttagaagtcaatgagggcacttacagctgtgtttcccttcactaacttttcatctcttgcattctttacttctctttctcaatttattcatcttgaggtatacttatcctgagttgactctgagcagcccatcctcaaaacacaaacaatgttaggatgagaagttgagtgagcacagagctcgaacacgtgcatggtacttaatgtttccaaactcgagcccaatcagtctagcacagtcaatcccactgcattttaatgactaggatggggcctgctgtacatagctggacatcttggattacagaaaagaggctttatgtgaaggcagcattttctttgtggtagagcaacatagttatcctgctaactgtcctatttgacctgatggaatccataaggtcctgttgatgggttggttctaagaggatggagaagcagaagtcattctactgagaacagacagtcctgttgcttagatacatacatattctttatgacagaattcctcctgagactcttgcacaccttcagtgatcagcgcattcactttggttatttcttggtaacaggcacgagaaatgggtcacatagaaatctgaagagtcatttctcgagcatttttagcttattcccatgtaaagaggcactgagctcctgcagttctagcctgcctctgctcccctccttggggaatggtggagtttctaggataaccagcaacccattaggctccaccacacttagcctatggtacattctgagtaaatcacagtagttggtatgtgaatacagaagaatttaccataaccacttctccaaataacctcctttgacttggaaataagatcatctttcagttttacagatgagaagtcaaagcacaaaattggataattagccaaaagtaagattatacagaaaattcttgacagaaccaaaacttggctgaaccaaaacttgtccaaatttctaactctcagtctagctcagcgagtaatgctgcctgaattgtctgcccccactgtaggttttcagcatctagcagtggagaaaagtcacgaaatctaggcagctgatttagccagatcttatctatgaaatttccctttgtagacacacacacactccacatacatctacagagacaagtcaaaaagagcaagaagaaagcaaaaatttgaaaatcagaaaggttagagaggtttccacggtgaagaaaacttggtcaaataaaaatgtttttgaattctatagggtaagatattgtgaataattttttattattaaaaattttttttaggtagcatgtaatccacataaataaaaaactcaagaataaactgggacagaggatttcttccagagtgctacatggcaaaagagccttcaggaacgtgtgcaggggtgtcatgatactccgaaggtgtcagtagttttggtcagcccacagtgagcagggcagcctcaagggagagccccttacatccttttctgggcacctctgtctaattaagttcaaacatacaagcctgattctaggattaaggcataagttagttctgaacagaaaaatataaggcagttcacatacacaatgaattcttgaagaaagaacctatagcccccagaccgataataaataattactgcctgccaaaatcctgaagaaagggaagcatgggggctccaaaattaatagtctcctgagaatacttatgagaccttgattttgtcacaaggttgcaatggtgaattatttattaagcacccgcagatcagagaatcttgcaacaaccttctcttacaacccacctgttcacttatgaatgatatcaagctcaggatataatccatctttccaaagattttagtatctttagtttgggctgcagaagaaattttggctcacagcattatgcttaaaccaaaaacagtgaaagagctctagtgtcctgcttaatgtagagtaactttttttttttatcagtccttcctagccctagagggaagataggagaggaggtaggaagatggaaaagtccttagatgaatgagtgaggagacttctataccatcaacttcagagtgtactgatccccggagcctggttcaggaggctagtttcagatgatcggaggaaatggaggaggtagcttttattcccatgcatgaagatggggggaggaggtgggcactagactaattttttaatctaaaaaaaatcaagcctattacaaatctcatttttcccttgtccttttgcctcccaataattcacataaaatcgtgttatcatagtaagctaagagagaggggcagtagctatttctaccttgactccgtggtgacttcatctttttcatgagtgtcattacagatacctggatcatgatgatcctgaaaaacaggtcacagggccaacagctgatgagtatttggagcatcttattcccccaagatgaccactccctgtcttctgctacacctatattcatcgggggggggaggtgggaaaatagcaggattcttggggactctgagggcatgaatggagaattatttgattgaaaccacagagctcttgtacttagtattaaatattaaaatagaaatgaaaagttcagcttttctgagctgtaccatagcggccaatggaggaagtcttacaaagaaaatctatatctgcacaagactgaagccactaaaccgagtatacacaacataaagatatcttcctatttcaagtatcccttagggggcatgggtgcttagctatcctatgaaagacagagaagataagctcaattttagagcccagagcttgctccggaacagcaagatccacatgaacttaaactctttcccactgagcctaggggtggaatgtaattcctctgatggttttgatttatttccaagctagacttctctatttgatcattggcaccttggcagctcacacatctccgtggtctcttctgtagctttcagaaaaaaaaaaaaaatatatatatatatatatatatacacacacatacatacatacatacatatacataaccctgtttgggtaaggcctattgacagaagccagatatctgggtggaagttagaagatgggcaaggaattcttatctcagagtttcaacactgcgacaatgtggagagaagtctcctgggaaaatgcagatgcccaataacttccaaaagaatcagggaagttggagtatttttgagatttacagtgtctttacttcagtaaaacaagccatagcaacattatgctctgcagagtcttctgttcacctttggatggaaaagagctgcttctcctagggagacaactaagaccaagaacaaaactcccatctcctaggccaattattgttttctcctttcctttcttttttattctctttgttacataatggtgaaatctacctggccattgccagtcaaacattctaattgctaaatatcatacagaaattcatgaaaaaagagtagaatcagcagatttcatttaatcccaagggtctttgcagttttcatcctctccctcaaagttatctcttctttgagacacatgatcacccctttcctcttctgggtggccatgattccaaaatgaacttcagtggttggtgcttcacaaaaggaaagacagctataatataaaatagaccaaaatacttatatttttagccactgcaaagtgggttttatcgttgagaacaaccttccaagctccttacttggaaacccttcctcacctcccagcctcctggcagctctcctggttccccttcatgtttttggctcccctccccgactttcctttcctatgaaaatgggatatatcccttaaactgtattcttatctaaactatcagactgttaaaagaaacccttgacagtaatttttcatggttttctcatcattttttaacttaggaagttggagaaagaatgacaagcaggcaaatgaggtcttgttcctgagtgcttcaactcaagatcaagtgctgggatagtgagtggctcttagtggagagggatgtgctctggaatattaagccacctctgagcatgtgtcctggtgctctggtcaagatgcctgttgtgtatgtggaggtattttgtggcttttcttgttctctctttttaaatttatttcaaggcacaagccctttgtgatggaggatgtctagcttgaacatgctggtaatgtgacactatcctcagctccccttggccctgggttcataggaggcaagtgtttctaaatttctcgcccagtgagttgttgcatgttatttttaaccattaatattgtgtgtctattggaatgagaaacagaaggttgaatgggaaatagattcagtgacaagcagacaaaaagcttggttctgagaaatgttcttcactgagttgaaaaaaaaataatctagaaacaaagaagagggaaattggggtagaatggtttggtggtgaagagacgatgacacccacatccagatgctctggtgtattccctcagagatttgtcattccctgtgagctctggcagaaggagaggctgtgctgccattgatggctcagaaatggtgacaggctggctttagaaagagacgtaggctttcttccagacagacattgataagcattgtagctcgattcttcaaaaccttgtctacaaacctttagggcagcccctctccaatgatttccattctccagtcaagaagattctgagtggaagagccttgtgtgcattgtgattacattgacttaaattgggaagccaaggggcactgagaactgaatatatcaggggaatggagttagctgaacctttttttttcaatattggaatgattttggatcacaaagttaggtcacctctgagagagaaaatctgttaaataaaattatatcttcccatctccagtgaaatcactaggttgttaatgtgattactgtttacttcagaaagaaaattgctagattcgattacaaataggcattttacagattgatttaatcctgagtcttacacatattaacatggaatttactgactcagacatgatcttctaagctataaaatattactggcgggtagtagatcatatgttctaagcaaaccaggaaagctaaaacgttaagtaatcctcccaaatattcagcgtctgtgtatttcactatagctgaaggggatttgggagttaggccgcaggggagaggagggacaaagtgccatagattaatgaaactcggagtaacttttttcttacctattaaaaataataattaacccaaggacaattctcaaaccagaaaaatcatgaaaagtgagctctgcacttgccattggttaaaatttagaaacacttagaataaatatccaggttttgggggaggagttgtttccttgcttgcattgttttgtttactggagctcttattttggggatatttggtctgtggcttcagagcatgttttggataaatgacttatccatgttgatatttattgagtggaaacccatgccaggctgttctaggtgctggaatataagaacgaaccacacaaagtccataccctcttgaagtttgtatgttgatgagaggaaatggacaaaaaagcaaatcaatagatctcatgtcagatagtgcaaagtgtcatgcagaaaaatgaggcagattaagggggatagatgataggatgggtgtggggttgctatttttgagtaagcaaagatgacatttaagtaaaggtttggaggaaatgagggagtgagacttggggctttctatgcaaaggcaaagagaaagcaattgcaaaggccctgctgtcaaaccaaatgcttggcaaacttgaggaagagccgggaggccaatgagggaggaggagagtatgagaggtgaggtcagagagggggcaataacgcaagtcaggtagggccttgtaggacactgtcaggatttggcttttaccaagagcaagatgagaagttgctagaaggttcggagcatagagtgatatgatctgacttcagttgaagaggaagctttgggactgctgtgttgagagtataccctgagagggcagacaatggaagcggctgaaagaccggttaggaagctcttgcaataatcctggtaagagatcatagttgcttgggccatgatgttagcaggggaggtgataagaagcagttggattccagaaatgttttaaagaatcgatatcacacagtttgctgatgaattagacattgaataagagaaagaaaaatcttaagaataaccttagaatgtttggcctgagctattgaaagtttggagttgccatcagtgtaagacaggaatcctgcaggtgaggctgactgggaaggaaagccttatagtttaaggtgtctacagatgttgcaagtagaaatgatgattaggcaattagatatatggacctggagttcagggaaaatgtatagcctgaagatacatatttaaaatttgtatgcgtttggttggtatttgaagccatgatactggaactagagaatgagtagcgacagaagaggattctctagactgaggcccagggtggaggattgttcaaagctccaggagatgagaagggaccagcaatgggaggagtggttaatgggtaaagcaagtactattattgagtaggataagactatctggaaacatggaggtcatcccattgatgacctggaagagagctgtttcagtggactggtgggggcaaaagcatgatggggtggattcaagaaagaggggaaggagaggaggtagagacaacaggaataggcaacgctttaggagtttggctgtaaagaggacatggaaatagcagatcatagagaatgtgacgcccagggagggacttctttttttaagatgggaaaaataacagcccattttatgttgacaagactaatccaggagaaaggaaaaattgatgatgcctagggagagaggacaattgctggagtaatgtctttgatgaagtgagagggcatgggattcaatacaaacatagagggactggcttcaggggactaaccaggtttgtttgtattaatagcagggagatagtgcatttgggcacagatgcaagtgggctggtaaatgggataatgggagtatgctttttctgattgatttttagtaaactatgaaaggagttcatcagttaagagtgagtataggggaagagtattggaggttttggaaggaagaaagcatgaatgagtcatatagccatccggcaggaagagtgagaacaaaaatgtcggagacaccaaaaatataggagacatgctagggggcataaaggaattatttgagtttttatgattatgagtttaaagaaatttgttttcttcagtcaccttcagctgcttaaacagggtggcaagttagattggaacagggttggggtataaccaggtgaatataatgaaagcaagagatgtggagtcaagggcaactgcagtgtgttaactataatgtttggtcatggaatctaagctgggtgtagaggaaagtgaggatttttagggaaggaggaacaatgaagcatattagaggcagaggattgagattcaagctgggatcactcagttagtgagtcagaagcaataacgtagaaattaggaggtgggttggagaggtggatgcttgaggttatggagggcttgcagttattggtggtttggggtctgttgttggggtggtgggctgagataagatagaggaaaaggttatagaaggagcaggggtcaaggaactgagaggccaggatatgggaattatatagatattgaagtcaacaaaatgttgacttccatatgataggaatgtaaattatgacaggaatgagggagagtgattcgagaacatttcaatcattgcatcaagtaaggggtgcagctagcctagtctgatgtgcatcaaagctggattttatggttgttgcatgttatttttttttaaaaaggagggaggatggtctggaatggcaatgaggggcaagaagggcatctccacctccaggccccagggcatgaggaaggtgcaagtggaaatgctcaccacctgggagtgattcagggtcctcaaagaggagccaggtttctgtaagagcaagaggaaaggaattgccagggttgtggctggtgatgaaccactgattcttaggcaggatttgggagttggtaaaggaagggaaatgagctgagatgggagatgtgcatgggtatctggggatgaaagtccaagtgataagagggactgggggtcttgggcttctcgtggtgattgccctaagcgaggctgtgggcatttggggttggccctaattgtctctatgtcagattgaggtggtgatgctgcaagtgcccggggcagggacttgatggcagcacatggaactctggtacctcttcctcagtcctgatatttgcttttttaacttctactaaaaaccccactgctaactgtgataggccacaacatgtttttatagatgtcaacaaatgttatcctggattgagaccacattttgactatttatcctggaaagtacacattttcacaggaaatcttgtcctttctaaggttcccaactaagctagtctcgttgtgggggggtcataattatttgttcttacttaccttactccttgttcatctttaaaaaaaaaatcaaataaaaaggattggaaagcaactttgcttctgcccaattctgctaaatgaaagttttctctgacagatcattttgattttgtattttcttttgtgacagaaacagtgggacaggagcatggaaatgaatgaaagtctttaaaagccttgagagagcgttttcaaggatcaggagagggcttagaaagaaaaggactctgagtggggctgcatgaaaagggggtaagtgaggactcttggggagggtctgaaaaaaacaagtagtttggcaaggagagcagaaaaataaaattccactgtgtaggcatttggagatttagcaagagcaacctagagtctgcccccagagacactgcacgttgtttctgacacagaggatgcactaattctatttcctgtgccacctgaaaaaatcataatttgagaagagaaactgttaggccatttctagtgaactatttttccaaaccctcacggaaccctgaacagggtgtgaatgagatcacaactactgctgctgctggttcagcctctctgtccactaataaaggcaaacccttcagcatggtcatatcctgccagccgttttcccccaaaagattaaattatgttcatcttggctcatctaacgccacatcttgagttcttaaggtatcacagccaactcagtcataccttactttatgcactgagtacgcattaaactctatttaggaaggaagagggaagcaaaggaagccagggatggttttgtcatgacctctctttgctttctgacctcccggaatccactctttggaagatgtgcagaaaacaatgtgacttccatttaccctgcctcagatctcccctccttcagactggctcccacccctggttaatggggtaacctgggtacgcctatttgttaaaggaatttgtgggaagtgaggggcaaaattgttggagcagagggaatagatttatgggagctttgttacccagtgactatcccagcattaatacttcagagtagccctgacgcttgtggaaacatttcaagggagctagaggcaatgttacagtggagatcagagaagggatggggcagtgagctcttgtccctaggggaaatctcttttcctccacgtgacaggagccagtgctccaacagcatcagaattacacttagccacaatgactgatgcgtgtgtgtgcctgtgcacatgtgtgtgagcgtgtgtgtgagcgcacgtgtgtaagggggtgatgatggaaacatgatatgcatccactatggggttgcgttgcaaattcacagctgcacccctcccaaagtcacatggcagaggggaaatggtcatagctttcctgtgtgatgtcctctccagggagcaccgacgactcaggcttgcctcagctctgcgaggcccagactccacactcctccctggggccggctctccttcctcttgactctcagatccccagcccatccacctccaagttctttttttgtttatttgttttgcttctgttttctgtaaatatctatttcttattttggacatgcagggatcaattgagattctggagtggggggaggggcggatgactgggtctttttattttttcctttctctcttggattttggtgtttgaacttgaaaaaaataattacaagtatatatataagcaaatgacttacctttaaacaaaagaaataagttgatttcattcttttgatttatcttgtttctcattggggtcgggtgggggtggggggtcttttgggtggagggcttttttgtgagctgtatagatttccagtttggacttgttcaaatgatgcaggaacaaaaattaaaacgaattaaaaaaaagacaacataaaaaaacaagaaaaactttgtgatgtataaaagctgtaaatagtcaaagattctttctcttttctaatggcaaattatttctgtcactttatattcaaaaaataaagaaacctaccacaaattatcagggttaaaaaaaatccagaatcagagtttttttcttggtctttgtgctttctttactgtgattccaaaaagattgttaaaagtgctgtttgggaaaaaccccttgcccagttggtttccaattgttggtaggagtcttggactggcgaatctacttgggttgggatctgtttctactatagctggtgctggagcccttggttacactcatctccccctcatgtattattctgaaacaaatcccataattatatggtttcatctgtaaacattacagtatatatctcttttactaaggactcttttttagtttaacaataccattgtgacatcataaggtagccataattccttgataagaaatatccagtgttcactaattgtctcaaatgtaatactgttttatggggtggtggtgggtttttttcccataagtcataaggtccatacaattagttgctatttctcaaatgtattttaaatctaaagatttgctttctaactttttcttgacatatacttgttaaaggaatagagcactttatcctttagaggttcccacagttggattttgctggttcttcccaatattaatgaagacaatgtaaattggtaattgttttactctttaatgcatacttccattgcttggaggtgtcagaaaagcaaaccagcccttgttttgctgattgtttcccaccccactcccagtcccagtcctgttactggctttatatatggattctaaatgatctctctttctataccttgattgctaaattatccaagttaaataatagtatctcccccttagctatcttggtaagaaaatagcatagacatatttagcttttcacatgccaatcatgaggcacatttcaacatcactttattaaaagccacatgctcctcctatagtcctagtactggaaaggaccttctagagaccatttagaagaactctgtctcatggccaaggagcctgggtgagctcatgtatggcagccctggctagaagccagcagggctaatccctagttccaggaatctcccaggataatgtattgttatctctttgaagttactgtctcagagagattatctgtgagggtctctcttgtactttcctttgtactgaacaaaaattcttgtttctccctgaacattccagaaagtagcaagctctaacataaagccagattcttcccagatatagtgattctctttacttctggagatacttccttaaaccccaaattttttttggacaacagaactgctttaacaataatctgaaaattatacagtaagtttgatttgaaaatctgagatttgtttaaaaaaaaaagggggaagacaagacttgaaatcttggctctgatttttctgttgtttttgtttttttgtttgttttttttttgtttgtttgttttttaagagggtcttgctctgtcatccaggctggagtggagaggtatgattacggctcactgcagccttgacctcccaggctcaagtgattctaccacctccgcctcctgtgtagctgggtactactggtgcataccaccacactgggctgattttgtattttttgtagagacggggtttcaccatgttgtccaggctgattctgaactcctgggttcaagtgatctgcctgcctcggcttcctatgatgctaggattacaggtgtgagccactgtgcccatcttggctctagttttaaataaggaagcttgcgagtatttatctggattatggtgggaacctccagtaggatatcatgaaagctttgatcatgatcacaacaccttcaataaaacaaagactccaatgacaagggtgagtgccagaacttcctgagactatgccaagtgtctgttctttatacagcctgcctcacccacacctggaatctcttaaatggattagctcagagcacctgtgtcctacatgcccttgtgccaccctgaagtccactgcaagggactatcagtaagaccagtctaatgaaaggctgagggagcacccggttgtgtccccatcagccaactgttccggaaagatgagcctccttggctgtcccaggattgacactcttcccctgcatacatcactaggaaggtagaacctaccctgaacacttgatttgaatatttctattcccctattcttttacaaatgcaaactaattctttcaaaaatataaatgatcctctgaaagaaatttcttgtggaattctggaatgaccaagaagatgggaagagaccaccagaaaagtggttctgagagtctgcagggcctgtcaaaaaaattatgccaaagctatcatttgtggcctgcatcaaatcatctagacttccgttttcttatcttgaaacccagatgttggtctatctgccctccccatcaaaggttacctggagcagtagttctcagttttacatagtggagtcatctgagtatttctgaaatgctgatgcctgagtctcatcccctagagagtctcattcaattgtcctgggtggctggaggggttaggggttgaaaacttgcccaggtgattttaatatacagccagaatgtgaaccactatgtatgtgcatctggggaaagcgggcctcctatttacttctaatcccattatatgtggcagctgtttgttgtcactctcctctcaccatggacaactattcacagcacagacagtcaccctttggaactccaggacctctttcctcttccatttggagctgaagaatggacataacggaagcaccattttatgattacagcctcgttctctaattctgcctatccccagcatacacggctagatatagacatactgcaaagctcctctatgtaaaggaaattctacacataaaatttaaacttggaatcga

SEQ ID NO: 137506 - DNA, 595 bp, Homo sapiens
  Payload ID: 6919
  Gene Symbol: GRIN2B
  Gene Name: glutamate receptor, ionotropic, N-methyl D-aspartate 2B
  ENST ID: ENST00000627535
  CDS Start-End: 490-595
gcttcgtgggtttctcctccccccggagtcagggtgtgcgaggaaggggacgctttgggaatgaccatgctccaccgagggacggagccggcccccagcttctccacacagagcctcctccactaacgctccaaaaaccaaaaaccgtaattgccagaagaagcgttaaaaatctattccagccactaacctcacatgcacacggaataattactctggattctgcattgtgagctgctctccataccctgaattacctttgaattaaatctttttttttttgaatttgcatctcttcaagacacaagattaaaacaaaatttacgctaaattggattttaaattatcttccgttcatttatccttcgtctttcttatgtggatatgcaagcgagaagaagggactggacattcccaacatgctcactcccttaatctgtccgtctagaggtttggcttctacaaaccaagggagtcgacgagttgaagatgaagcccagagcggagtgctgttctcccaagttctggttggtgttggccgtcctggccgtgtcaggcagcagagctcgttctcagaagagcccccccagcattg

SEQ ID NO: 137507 - DNA, 830 bp, Homo sapiens
  Payload ID: 6919
  Gene Symbol: GRIN2B
  Gene Name: glutamate receptor, ionotropic, N-methyl D-aspartate 2B
  ENST ID: ENST00000630791
  CDS Start-End: 725-830
gcttcgtgggtttctcctccccccggagtcagggtgtgcgaggaaatctcggggcttcgctctatcgagagtgctcgtcaagggtgattcttgatcaccaccatccagtagtgctggcgtccgaatgcatatccttttgccttgcaaagaagagtcatgaacttcaaaacccccgagacggatcattaatcctgctttgcaggaaaggaaaaccctccattcccagccaccggccacccctctccgcagactgcaaccgcggaggcgctcggagccggaaggggacgctttgggaatgaccatgctccaccgagggacggagccggcccccagcttctccacacagagcctcctccactaacgctccaaaaaccaaaaaccgtaattgccagaagaagcgttaaaaatctattccagccactaacctcacatgcacacggaataattactctggattctgcattgtgagctgctctccataccctgaattacctttgaattaaatctttttttttttgaatttgcatctcttcaagacacaagattaaaacaaaatttacgctaaattggattttaaattatcttccgttcatttatccttcgtctttcttatgtggatatgcaagcgagaagaagggactggacattcccaacatgctcactcccttaatctgtccgtctagaggtttggcttctacaaaccaagggagtcgacgagttgaagatgaagcccagagcggagtgctgttctcccaagttctggttggtgttggccgtcctggccgtgtcaggcagcagagctcgttctcagaagagcccccccagcattg

SEQ ID NO: 137508 - DNA, 4261 bp, Homo sapiens
  Payload ID: 6920
  Gene Symbol: GRIN2C
  Gene Name: glutamate receptor, ionotropic, N-methyl D-aspartate 2C
  Uniprot ID: Q14957
  ENST ID: ENST00000293190
  CDS Start-End: 148-3849
tgtccttgagccgcgggtgacggtggctctcgctgctcgcgccccctcctcccgcggggggagcctgatgccacgttccctatgaattatttatcgccggcctaaaaataccccgaacttcacagcccgagtgaccctccggtggacatgggtggggccctggggccggccctgttgctcacctcgctcttcggtgcctgggcagggctgggtccggggcagggcgagcagggcatgacggtggccgtggtgtttagcagctcagggccgccccaggcccagttccgtgcccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggagctgggcccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccccggccggggactgccgtgttcaccctgggcccgtcagccctgcccgggaggccttctacaggcacctactgaatgtcacctgggagggccgagacttctccttcagccctggtgggtacctggtccagcccaccatggtggtgatcgccctcaaccggcaccgcctctgggagatggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagaagtccgggggcccagctttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagctacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatggggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatggcaggcgtcttctacatgctgctggtggccatggggctggccctgctggtcttcgcctgggagcacctggtctactggaagctgcgccactcggtgcccaactcatcccagctggacttcctgctggctttcagcaggggcatctacagctgcttcagcggggtgcagagcctcgccagcccaccgcggcaggccagcccggacctcacggccagctcggcccaggccagcgtgctcaagatgctgcaggcagcccgcgacatggtgaccacggcgggcgtaagcagctccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccgccccttcctcccgctcttcccggagctggaggacctgccgctgctcggtccggagcagctggcccggcgggaggccctgctgcacgcggcctgggcccggggctcgcgcccgcgtcacgcttccctgcccagctccgtggccgaggccttcgctcggcccagctcgctgcccgctgggtgcaccggccccgcctgcgcccgccccgacggccactcggcctgcaggcgcttggcgcaggcgcagtcgatgtgcttgccgatctaccgggaggcctgccaggagggcgagcaggcaggggcccccgcctggcagcacagacagcacgtctgcctgcacgcccacgcccacctgccattttgctggggggctgtctgtcctcaccttccaccctgtgccagccacggctcctggctctccggggcctgggggcctctggggcacaggggcaggactctggggctgggcacaggctacagagacagtgggggactggacgagatcagcagggtagcccgtgggacgcaaggcttcccgggaccctgcacctggagacggatctccagtctggagtcagaagtgtgagttatcagccactcaggctccgagccagctggattctctgcctgccactgtcagggttaagcggcaggcaggattgggcttttctggcttctgccatgaaatcctggccatgggaccccagtgacagatgatgtcttccatggtcatcagtgacctcagtagcctcaaatcatggtgagggctgggcttttgctgtcctcttctcacgcagagttctgccaggagggtgtgctgtgggggtcagactcctgaggctctcccttccctggggctagccagttactggtcatggctgctgtgggcatggaggctggaacttgtggttgaggcagggccatcccgatccttgctctacctggctagagtttcttctcatcagagcactgggacattaaaccaaccttttacaaca

SEQ ID NO: 137509 - DNA, 2929 bp, Homo sapiens
  Payload ID: 6920
  Gene Symbol: GRIN2C
  Gene Name: glutamate receptor, ionotropic, N-methyl D-aspartate 2C
  ENST ID: ENST00000347612
  CDS Start-End: 103-2724
cgcgggcagggcggggacacgcggagcaaaggcacccggcaacctgaacccccaggtgcgtcccgcgaccctgcaaggagctgctgggaccctccggtggacatgggtggggccctggggccggccctgttgctcacctcgctcttcggtgcctgggcagggctgggtccggggcagggcgagcagggcatgacggtggccgtggtgtttagcagctcagggccgccccaggcccagttccgtgcccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggagctgggcccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccccggccggggactgccgtgttcaccctgggcccgtcagccctgcccgggaggccttctacaggcacctactgaatgtcacctgggagggccgagacttctccttcagccctggtgggtacctggtccagcccaccatggtggtgatcgccctcaaccggcaccgcctctgggagatggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagaagtccgggggcccagctttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagctacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatggggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatggcaggcgtcttctacatgctgctggtggccatggggctggccctgctggtcttcgcctgggagcacctggtctactggaagctgcgccactcggtgcccaactcatcccagctggacttcctgctggctttcagcagggtgggtgcccacccctccccacacaggccaaagttttaagggcacctacccagataagtccgggctggccatggcccatttccagaggtaaaaccaaggttctggcccggctcatggctcacacctgtaatctcaacactttgagaggcttaggccagtggatcccttgagtccagaagtttgagaccagcctgggcaacatggcgaaaacccatctctacagaaaataaaagaattagctggg

SEQ ID NO: 137510 - DNA, 5093 bp, Homo sapiens
  Payload ID: 6921
  Gene Symbol: GRIN2D
  Gene Name: glutamate receptor, ionotropic, N-methyl D-aspartate 2D
  Uniprot ID: O15399
  ENST ID: ENST00000263269
  CDS Start-End: 89-4099
ggacgccgggttccggtcctggcccccccgccatccccccaacagaacagggtcatgaaaagaggccgcccggcggggcccgcaggcgatgcgcggcgccggtggcccccgcggccctcggggccccgctaagatgctgctgctgctggcgctggcctgcgccagcccgttcccggaggaggcgccggggccgggcggggccggtgggcccggcggcggcctcggcggggcgcggccgctcaacgtggcgctcgtgttctcggggcccgcgtacgcggccgaggcggcacgcctgggcccggccgtggcggcggcggtgcgcagcccgggcctagacgtgcggcccgtggcgctggtgctcaacggctcggacccgcgcagcctcgtgctgcagctctgcgacctgctgtcggggttgcgcgtgcacggcgtggtcttcgaagacgactcgcgcgcgcccgccgtcgcgcccatcctcgacttcctgtcggcgcagacctcgctgcccatcgtggccgtgcacggcggcgccgcgctcgtgctcacgcccaaggagaagggctccaccttcctgcagctgggctcttccaccgagcaacagcttcaggtcatctttgaggtgctggaggagtatgactggacgtcctttgtagccgtgaccactcgtgcccctggccaccgggccttcctgtcctacattgaggtgctgactgacggtagtctggtgggctgggagcaccgcggagcgctgacgctggaccctggggcgggcgaggccgtgctcagtgcccagctccgcagtgtcagcgcgcagatccgcctgctcttctgcgcccgagaggaggccgagcccgtgttccgcgcagctgaggaggctggcctcactggatctggctacgtctggttcatggtggggccccagctggctggaggcgggggctctggggcccctggtgagccccctcttctgccaggaggcgcccccctgcctgccgggctgtttgcagtgcgctcggctggctggcgggatgacctggctcggcgagtggcagctggcgtggccgtagtggccagaggtgcccaggccctgctgcgtgattatggtttccttcctgagctcggccacgactgtcgcgcccagaaccgcacccaccgcggcgagagtctgcataggtacttcatgaacatcacgtgggataaccgggattactccttcaatgaggacggcttcctagtgaacccctccctggtggtcatctccctcaccagagacaggacgtgggaggtggtgggcagctgggagcagcagacgctccgcctcaagtacccgctgtggtcccgctatggtcgcttcctgcagccagtggacgacacgcagcacctcacggtggccacgctggaggaaaggccgtttgtcatcgtggagcctgcagaccctatcagcggcacctgcatccgagactccgtcccctgccggagccagctcaaccgaacccacagccctccaccggatgccccccgcccggaaaagcgctgctgcaagggtttctgcatcgacattctgaagcggctggcgcataccatcggcttcagctacgacctctacctggtcaccaatggcaagcacggaaagaagatcgatggcgtctggaacggcatgatcggggaggtgttctaccagcgcgcagacatggccatcggctccctcaccatcaacgaggagcgctccgagatcgtggacttctccgtccccttcgtggagaccggcatcagcgtcatggtggcgcgcagcaatggcacggtgtccccctcggccttcctcgagccctacagccccgccgtgtgggtgatgatgttcgtcatgtgcctcactgtggtcgccgtcactgttttcatcttcgagtacctcagtcctgttggttacaaccgcagcctggccacgggcaagcgccctggcggttcaaccttcaccattgggaaatccatctggctgctctgggccctggtgttcaataattcggtgcccgtggagaacccccggggaaccaccagcaaaatcatggtgctggtgtgggccttcttcgccgtcatcttcctcgccagctacacagccaacctggccgccttcatgatccaggaggagtacgtggatactgtgtctgggctcagtgaccgcaagttccagaggccccaggagcagtacccgcccctgaagtttgggaccgtgcccaacggctccacggagaagaacatccgcagcaactatcccgacatgcacagctacatggtgcgctacaaccagccccgcgtagaggaagcgctcactcagctcaaggcagggaagctggacgccttcatctacgatgctgcagtgctcaattacatggcccgcaaggacgagggctgcaagcttgtcaccatcggctccggcaaggtcttcgccacgacaggctatggcatcgccctgcacaagggctcccgctggaagcggcccatcgacctggcgttgctgcagttcctgggggatgatgagatcgagatgctggagcggctgtggctctctgggatctgccacaatgacaaaatcgaggtgatgagcagcaagctggacatcgacaacatggcgggcgtcttctacatgctcctggtggccatgggcctgtccctgctggtcttcgcctgggagcacctggtgtactggcgcctgcggcactgcctggggcccacccaccgcatggacttcctgctggccttctccaggggcatgtacagctgctgcagcgctgaggccgccccaccgcccgccaagcccccgccgccgccacagcccctgcccagccccgcgtaccccgcgccgcggccggctcccgggcccgcacctttcgtgccccgcgagcgcgcctcagtggaccgctggcgccggaccaagggcgcggggccgccggggggcgcgggcctggccgacggcttccaccgctactacggccccatcgagccgcagggcctaggcctcggcctgggcgaagcgcgcgcggcaccgcggggcgcagccgggcgcccgctgtccccgccggccgctcagcccccgcagaagccgccgccctcctatttcgccatcgtacgcgacaaggagccagccgagccccccgccggcgccttccccggcttcccgtcgccgcccgcgccccccgccgccgcggccaccgccgtcgggccgccactctgccgcttggccttcgaggacgagagcccgccggcgcccgcgcggtggccgcgctcggaccccgagagccaacccctgctggggccaggcgcgggcggcgcggggggcacggggggcgcaggcggaggagccccggccgctccgcccccgtgccgcgccgcgccgcccccgtgcccttacctcgatctcgagccgtcgccgtcggactcggaggactcggagagcctgggcggcgcgtcgctgggcggcctggagccctggtggttcgccgacttcccttacccgtatgccgagcgcctcgggccgccgcccggccgctactggtcggtcgacaagctcgggggctggcgcgccgggagctgggactacctgcccccgcgcagcggtccggccgcctggcactgtcggcactgcgccagcctggagctgctgccgccgccgcgccatctcagctgctcgcacgatggcctggacggcggctggtgggcgccaccgcctccaccctgggccgccgggcccctgccccgacgccgggcccgctgcgggtgcccgcggtcgcacccgcaccgcccgcgggcctcgcaccgcacgcccgccgccgccgcgccccaccaccacaggcaccggcgcgccgctgggggctgggacctcccgccgcccgcgcccacctcgcgctcgctcgaggacctcagctcgtgccctcgcgccgcccctgcgcgcaggcttaccgggccctcccgccacgctcgcaggtgtccgcacgccgcgcactgggggccgccgctgcccacagcttcccaccggagacaccggggcggggacctgggcacccgcaggggctcggcgcacttctctagcctcgagtccgaggtatgacgcggccccgggggccccaccgcccccttggtcagcgcaggccacggcccgagggggcgcccgcagtggacaggacccgcgtgggttgggaaggaaagcagtggaactggccggaccccgcctggagcagcgtcctgcgccccctggttctggaggaaccgcaagccggagaggatttggtccctcaactatcacccagcctgagaacgagggggcgggggccttggagcccaccggacttttttttaaacccgacaagggctttttaacgtcaccagatggggcgggaggtggggggttcacgccactcccgcgtcccacctccacgcccggggccgtggcccccacatcactgtgcagctccccggccccagccgcgcctccggggaagcccgtttttaacctttcatccattgggactcaaaactgtgagacgcgttcgccaaactgtgaccccagaccttggccccgccacacagaaacccctgacccagactgtgacatccgactcctaaaatggtcatccgactccagactgtgacccctgaccccaaactgtgacccgaaccccagactgtgccccgaccagactgtgacccttgacatcaaaccgtgacaccccctcctcctcttccaccctcggtcgcttttccctactctgacctaggacacgtccccaacggaagccccgccttcccttgcaccgcgatgaacccaacctccctgaagccaaaacttcccaccctgccgcacctccggaccaccccacttgccaccaagcacatcctctccaaatccaacccttatttgcgacccttcagtgatgacccagcagacctccaaaaagcctcctctgcccagatctccagccgggtctggggctgggttgcggaggggagggtctgggagtccacacttctccaccaacttcccttcccactctcttattccacattgcagtgtttggaataaaccatgtttttatgcctcctca

SEQ ID NO: 137511 - DNA, 1968 bp, Homo sapiens
  Payload ID: 6922
  Gene Symbol: GRINA
  Gene Name: glutamate receptor, ionotropic, N-methyl D-aspartate-associated protein 1 (glutamate binding)
  Uniprot ID: Q7Z429
  ENST ID: ENST00000313269
  CDS Start-End: 279-1394
aaggccccgctgcgtcttccgagccgcaggcgcaggcccagctgagcggccgccgagcgggtgcgggtgcgggcgcatcggccatcaccgcgcggccgcgcagcggacaccgtgcgtaccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctactggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgc

SEQ ID NO: 137512 - DNA, 1814 bp, Homo sapiens
  Payload ID: 6922
  Gene Symbol: GRINA
  Gene Name: glutamate receptor, ionotropic, N-methyl D-aspartate-associated protein 1 (glutamate binding)
  Uniprot ID: Q7Z429
  ENST ID: ENST00000395068
  CDS Start-End: 125-1240
tgagcggccgccgagcgggtgcgggtgcgggcgcatcggccatcaccgcgcggccgcgcagcggacaccgtgcgtaccggcctgcggcgcccggccaccggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctactggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgc

SEQ ID NO: 137513 - DNA, 806 bp, Homo sapiens
  Payload ID: 6922
  Gene Symbol: GRINA
  Gene Name: glutamate receptor, ionotropic, N-methyl D-aspartate-associated protein 1 (glutamate binding)
  ENST ID: ENST00000527194
  CDS Start-End: 1-553
ggacttccctgccaccaactgggatgacaagagcatccgacaggccttcatccgcaaggtgttcctagtgctgaccttgcagctgtcggtgaccctgtccacggtgtctgtgttcacttttgttgcggagtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctactggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcc

SEQ ID NO: 137514 - DNA, 564 bp, Homo sapiens
  Payload ID: 6922
  Gene Symbol: GRINA
  Gene Name: glutamate receptor, ionotropic, N-methyl D-aspartate-associated protein 1 (glutamate binding)
  ENST ID: ENST00000533044
  CDS Start-End: 1-564
caacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaagtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctactggggaacaagcagctgtccctgagcccagaagagtatgtgtttgctgcgctgaacctgtacacagacatcatcaacatcttcctgtacatcctcaccatcat

SEQ ID NO: 137515 - DNA, 1075 bp, Homo sapiens
  Payload ID: 6922
  Gene Symbol: GRINA
  Gene Name: glutamate receptor, ionotropic, N-methyl D-aspartate-associated protein 1 (glutamate binding)
  ENST ID: ENST00000529301
  CDS Start-End: 254-1075
gcaggcgcaggcccagctgagcggccgccgagcgggtgcgggtgcgggcgcatcggccatcaccgcgcggccgcgcagcggacaccgtgcgtaccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcag

SEQ ID NO: 137516 - DNA, 1050 bp, Homo sapiens
  Payload ID: 6922
  Gene Symbol: GRINA
  Gene Name: glutamate receptor, ionotropic, N-methyl D-aspartate-associated protein 1 (glutamate binding)
  ENST ID: ENST00000534791
  CDS Start-End: 1-1050
gggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactggtaacccccaaacctgagcctctgtgcctgggtccggccatgcagtcccacacgcccactcttccgggcctggtcaccgtggttctccttgtgctcatgaggcaggggccggcaggggtggcatgggggcacacacccaaggtcagcctgtgtctcccaactgcagtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctactggggaacaagcagctgtccctgagcccagaagagtatgtgtttgctgcgctgaacctgtacacagacatcatcaacatcttcctgtacatcctcaccatcattggccgcgccaaggagt

SEQ ID NO: 137517 - DNA, 558 bp, Homo sapiens
  Payload ID: 6922
  Gene Symbol: GRINA
  Gene Name: glutamate receptor, ionotropic, N-methyl D-aspartate-associated protein 1 (glutamate binding)
  ENST ID: ENST00000530898
  CDS Start-End: 256-558
gttgttgggctcgcgggggtgggggggctcgggcctttgttggtcacagatggcccggggatttcctgggatagaaatagccgccggctccggccccttaaagctgcttaaggggcgggatgcggaggggagggtccgggcacaccccacacgtccccggccgagaccccagcctccgcgctgagctcccacccgggagacgccggcagcggcgcaggcctccggttgcttgggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccag

SEQ ID NO: 137518 - DNA, 7770 bp, Homo sapiens
  Payload ID: 6923
  Gene Symbol: GRIN3A
  Gene Name: glutamate receptor, ionotropic, N-methyl-D-aspartate 3A
  Uniprot ID: Q8TCU5
  ENST ID: ENST00000361820
  CDS Start-End: 602-3949
cagagaggaagtagcgagagaagagagaaaatgaagtcggcgctgggggagcctgcaggagggtggccaacagtggaggaaggtggatttggcttcttttccgcaccccgggcgtgaaagccctctccaacgcgaccccaggaaataagtgggtctcgcctgggcagaaaaggaaaagaatccaggcgagagcgcgtcgctcctctgtcactgctgcccccgaggaactccggctgcttctcatcccggccgcctcgcggggccggacgcagtgcccgaggcgccctgcagatggggcgggcagggaacgggcgctccagctgcgggtgacaggcgccggcccgcccgcctgcctgctcagcgcagtgaccgggcgggcagaggatgccaggcggagggacctgggagcgggatctgagactgccggaggcgcgctacgctccaacttgcatggcctagagaccgctccagctcctgggaccgcttcaccgagtggagtgaagctgcgcgcgggacctggaggcggagacctcaggcagcggctgcagaggggcgagccgggcgcaggagggggcgcgctttctccctgcgggtctcagtaatgaggagactgagtttgtggtggctgctgagcagggtctgtctgctgttgccgccgccctgcgcactggtgctggccggggtgcccagctcctcctcgcacccgcagccctgccagatcctcaagcgcatcgggcacgcggtgagggtgggcgcggtgcacttgcagccctggaccaccgccccccgcgcggccagccgcgctccggacgacagccgagcaggagcccagagggatgagccggagccagggactaggcggtccccggcgccctcgccgggcgcacgctggttggggagcaccctgcatggccgggggccgccgggctcccgtaagcccggggagggcgccagggcggaggccctgtggccacgggacgccctcctatttgccgtggacaacctgaaccgcgtggaagggctgctaccctacaacctgtctttggaagtagtgatggccatcgaggcaggcctgggcgatctgccacttttgcccttctcctcccctagttcgccatggagcagtgaccctttctccttcctgcaaagtgtgtgccataccgtggtggtgcaaggggtgtcggcgctgctcgccttcccccagagccagggcgaaatgatggagctcgacttggtcagcttagtcctgcacattccagtgatcagcatcgtgcgccacgagtttccacgggagagtcagaatccccttcacctacaactgagtttagaaaattcattaagttctgatgctgatgtcactgtctcaatcctgaccatgaacaactggtacaattttagcttgttgctgtgccaggaagactggaacatcaccgacttcctcctccttacccagaataattccaagttccaccttggttctatcatcaacatcaccgctaacctcccctccacccaggacctcttgagcttcctacagatccagcttgagagtattaagaacagcacacccacagtggtgatgtttggctgcgacatggaaagtatccggcggattttcgaaattacaacccagtttggggtcatgccccctgaacttcgttgggtgctgggagattcccagaatgtggaggaactgaggacagagggtctgcccttagggctcattgctcatggaaaaacaacacagtctgtctttgagcactacgtacaagatgctatggagctggtcgcaagagctgtagccacagccaccatgatccaaccagaacttgctctcattcccagcacgatgaactgcatggaggtggaaactacaaatctcacttcaggacaatatttatcaaggtttctagccaataccactttcagaggcctcagtggttccatcagagtaaaaggttccaccatcgtcagctcagaaaacaactttttcatctggaatcttcaacatgaccccatgggaaagccaatgtggacccgcttgggcagctggcaggggggaaagattgtcatggactatggaatatggccagagcaggcccagagacacaaaacccacttccaacatccaagtaagctacacttgagagtggttaccctgattgagcatccttttgtcttcacaagggaggtagatgatgaaggcttgtgccctgctggccaactctgtctagaccccatgactaatgactcttccacattggacagcctttttagcagcctccatagcagtaatgatacagtgcccattaaattcaagaagtgctgctatggatattgcattgatctgctggaaaagatagcagaagacatgaactttgacttcgacctctatattgtaggggatggaaagtatggagcatggaaaaatgggcactggactgggctagtgggtgatctcctgagagggactgcccacatggcagtcacttcctttagcatcaatactgcacggagccaggtgatagatttcaccagccctttcttctccaccagcttgggcatcttagtgaggacccgagatacagcagctcccattggagccttcatgtggccactccactggacaatgtggctggggatttttgtggctctgcacatcactgccgtcttcctcactctgtatgaatggaagagtccatttggtttgactcccaaggggcgaaatagaagtaaagtcttctccttttcttcagccttgaacatctgttatgccctcttgtttggcagaacagtggccatcaaacctccaaaatgttggactggaaggtttctaatgaacctttgggccattttctgtatgttttgcctttccacatacacggcaaacttggctgctgtcatggtaggtgagaagatctatgaagagctttctggaatacatgaccccaagttacatcatccttcccaaggattccgctttggaactgtccgagaaagcagtgctgaagattatgtgagacaaagtttcccagagatgcatgaatatatgagaaggtacaatgttccagccacccctgatggagtggagtatctgaagaatgatccagagaaactagacgccttcatcatggacaaagcccttctggattatgaagtgtcaatagatgctgactgcaaacttctcactgtggggaagccatttgccatagaaggatacggcattggcctcccacccaactctccattgaccgccaacatatccgagctaatcagtcaatacaagtcacatgggtttatggatatgctccatgacaagtggtacagggtggttccctgtggcaagagaagttttgctgtcacggagactttgcaaatgggcatcaaacacttctctgggctctttgtgctgctgtgcattggatttggtctgtccattttgaccaccattggtgagcacatagtatacaggctgctgctaccacgaatcaaaaacaaatccaagctgcaatactggctccacaccagccagagattacacagagcaataaatacatcatttatagaggaaaagcagcagcatttcaagaccaaacgtgtggaaaagaggtctaatgtgggaccccgtcagcttaccgtatggaatacttccaatctgagtcatgacaaccgacggaaatacatctttagtgatgaggaaggacaaaaccagctgggcatccggatccaccaggacatccccctccctccaaggagaagagagctccctgccttgcggaccaccaatgggaaagcagactccctaaatgtatctcggaactcagtgatgcaggaactctcagagctcgagaagcagattcaggtgatccgtcaggagctgcagctggctgtgagcaggaaaacggagctggaggagtatcaaaggacaagtcggacttgtgagtcctaggtgaccacactgcttccctttctcagttcctgaccttcctctgagcccttgagacactttgtaatgctcttttgtaactatcgacaaaggtgtggggaagctgaggtctaggtcttcttaaaggtcaagtctgctctccctcgcctaaagtgcagcagcagctcctctcaagctcactctctaggtctccagggtaggagtgtttttctagcaagaatcttagtcaggagtaagctctgtgcgagagatctgtgaataaccagataaccccagctgccgttaaccttttcaccaggtgccacagtaatatttctggtttttagccctttctctgcactaccaacaagagataaaattgttactcacacttatgtcttactgggttgctggttttcatcgtaacacagaacgaggttatctagggttgtagcttttgatacaactccccgatctagatttattcctacattctgaatggggagcaggtaagagcagagcacctcccactgggggtggggtatttaaaaattaactcattagtatcataaacgtcaaggattgattggaccaggcaagagccatgtttttgagaaggttctggatctctgactccatcctgactgtttagtaagagcatgcttacaccctactgtgaaaaggggaggggatgtggtaagcggaaacagaagacaggcagcagaggcattaaaaatgcataccatgctttcagaacaaaagctctgggccagaaaggcaatttggctaaaaaatgaataagactacttctaatgtaactaagcatctccactatggtgtgtgccttttataaaggaaaagagagaaaaaggcaaagcaaggttgtggccttaggttggacctggaatatcccttattgcctataatggaatatgtgacactgtgggtgaaatgttctacacaccacacactaggccattttcagatcagcagtcacccatcgcttagcatagaaatcccaaaacctccagcccgggaacactataagcttcgaccattcaggaatctgccctgcactttgcatatctgtatagaaaatcaagtcaatcccccatcctcacacccactcatctctgaggagctatgaactggttttggtccctctaatgatcctccagcctcatctaatgccccccaaagactgatacaagtaacctcccctctgcttaggtgtcactttctcagcatatcaagtttaggcagcaagggaaaggaatatgggtcagttctcaaatgtcaatgtagataagagtcatctagtagagaactcatcagagtgcggattgccaagacccttctccagagattatggggttgggggtggaggtctagaggtgagctcagaaacctactgttaaccaacacccccaagtgactgacacaggtggtctaaaaattacttttctagaaacaccattctggaagtttggctgcccacaggcaggaggagaagcatgaagagaaaacctgtttgagaagttttgttttgttttgttttgctttttaataattttagcacacatctgctgactctccttcaacatcctcacccccacccctgggcaccatttaggacaagacttccttatttatcaattacttgatttatcttctcaggactcattgttccacccccaaccaatttgaatgcctacaataagttcaggagctgtgccaagcactttcctcttttacagctggagatcactggaaaggtgtctcagtcacaaaacttctccctctactactggatgaaatgtctgcatttccaccaaaatctacccagtcacccagggaataacaacttaagctgtagttagataacacctagtgattaattggctgagaaaaccctggagtggagggaggctcagagatactgatatggatgtgggagggctctaaagttagaggtcaccaactccacagatgaaacagttcaataatgaggaaacaggtgagccctgaaaacacaaaaggacagttctgtgttgaaacaccccatcccctcacgttctcaccccaggcccagaagtaggttgcaactgcctttggaagattttgccccttagccatccccacccacttgtaccagctaagaatgctggagactctgccaccatgctctgcgtgcccctgaacctctgtgcagcccggaaggctgatgtacaggtgtacctcaatccacattacagccatgctcctaatgtacatggacatttttgtaactcagctcatattctgactgtatttgagaagctggctgtttaagggaacccagaagtgaattcttttgtaaagtaaagcacccttttgtaatgcaattaattatcccttaatgtatctgttttgtaagtctgcatttttgtatatcggatttaccttaagcttctctagtgaggcattctgagcagtggtgatcacatgccagatcgccctgcctatccacaaagtagatgaccaatgcacgctcctcaaacatctttggaggaactacctggccaaaacactggccaggatgcagcaagcagcagcaggggctgacagcaggcttactgccatcaacattgcttgaaatgcctctatgttctgaataaagaaaaaccataattgcttgtggtgaaacgaagcagtcttcatgttaagtagcaatggttatttttattggtagtaactgaacagtgttttgcaatttgtgaaacagtgtattgtgttttgtaaaatgatgtcatgaaatggtgggtccttggaaacctcctttccgttcagctctgcctctgttctttcaactcctttgaggctcaaaaaaaacacaaagatcagaagccttcagatagagggtggtattctggtaaagaagaaagagataagggacgctaccttgcttttctggcacaggaagcacatgataaagcatgctcagatgagctggaacagatatagctacctggttcgtgtaaataagaataatcaaggccccagagtgtgtatgcttccaggtggaggagaaaggggaatctcccaaaatttaaaaacaaattggaagaataaccaggacagccaagtgaagcagccacagggacccaagcagtcgaggtctttaatgtgcctggagatgactctctgctattcatgaatcttgctattgcacaaaccctatcaagagctgctgcttcccttccagccagaaaagtggtaagcggagcaagtgccaagcagaacagaccttatcatctgggtaacagacttctcagtgttggtgctgtgtctgttagagccttagagcaagttaagcacttccttggtgtgggtaaagaataaaggggaaagaaactactttagagcctctttttctcccaactcatatttttgataggaaaaacagaaaacccatccagttcttcagaaattgctttctaggcattaatactactttactatctatactgtttagttattcctttctttacccacctaaactatccatctaatccaggattccctcactctttttttttagttactaatcattttatgaaaataatgtatttataagtattttcttaaggtttgtgaagagtatttgcattgtgtcttcattttaatgtgtttgcaatcgctccgctccaggaagaacggaaatgctgtcttgtgagcatgaagtgaacgggctgttttgctccagccacttttcttgtacaaccacatggatggattagatgtcctcaggtcttttccatcttcagtttctatgactgtggaataaatgttcagatagaaacttc

SEQ ID NO: 137519 - DNA, 3281 bp, Homo sapiens
  Payload ID: 6924
  Gene Symbol: GRIN3B
  Gene Name: glutamate receptor, ionotropic, N-methyl-D-aspartate 3B
  Uniprot ID: O60391
  ENST ID: ENST00000234389
  CDS Start-End: 20-3151
cgacgccgacaactttgcgatggagtttgtgcgggcgctgtggctgggcctggcgctggcgctggggccggggtccgcggggggccaccctcagccgtgcggcgtcctggcgcgcctcgggggctccgtgcgcctgggcgccctcctgccccgcgcgcctctcgcccgcgcccgcgcccgcgccgccctggcccgggccgccctggcgccgcggctgccgcacaacctgagcttggagctggtggtcgccgcgccccccgcccgcgaccccgcctcgctgacccgcggcctgtgccaggcgctggtgcctccgggcgtggcggccctgctcgcctttcccgaggctcggcccgagctgctgcagctgcacttcctggcggcggccaccgagacccccgtgctcagcctgctgcggcgggaggcgcgcgcgcccctcggagccccgaacccattccacctgcagctgcactgggccagccccctggagacgctgctggatgtgctggtggcggtgctgcaggcgcacgcctgggaagacgtcggcctggccctgtgccgcactcaggaccccggcggcctggtggccctctggacaagccgggctggccggcccccacagctggtcctggacctaagccggcgggacacgggagatgcaggactgcgggcacgcctggccccgatggcggcgccagtggggggtgaagcaccggtacccgcggcggtcctcctcggctgtgacatcgcccgtgcccgtcgggtgctggaggccgtacctcccggcccccactggctgttggggacaccactgccgcccaaggccctgcccaccgcggggctgccaccagggctgctggcgctgggcgaggtggcacgacccccgctggaggccgccatccatgacattgtgcaactggtggcccgggcgctgggcagtgcggcccaggtgcagccgaagcgagccctcctccccgccccggtcaactgcggggacctgcagccggccgggcccgagtccccggggcgcttcttggcacggttcctggccaacacgtccttccagggccgcacgggccccgtgtgggtgacaggcagctcccaggtacacatgtctcggcactttaaggtgtggagccttcgccgggacccacggggcgccccggcctgggccacggtgggcagctggcgggacggccagctggacttggaaccgggaggtgcctctgcacggcccccgcccccacagggtgcccaggtctggcccaagctgcgtgtggtaacgctgttggaacacccatttgtgtttgcccgtgatccagacgaagacgggcagtgcccagcggggcagctgtgcctggaccctggcaccaacgactcggccaccctggacgcactgttcgccgcgctggccaacggctcagcgccccgtgccctgcgcaagtgctgctacggctactgcattgacctgctggagcggctggcggaggacacgcccttcgacttcgagctgtacctcgtgggtgacggcaagtacggcgccctgcgggacggccgctggaccggcctggtcggggacctgctggccggccgggcccacatggcggtcaccagcttcagtatcaactccgcccgctcacaggtggtggacttcaccagccccttcttctccaccagcctgggcatcatggtgcgggcacgggacacggcctcacccatcggtgcctttatgtggcccctgcactggtccacgtggctgggcgtctttgcggccctgcacctcaccgcgctcttcctcaccgtgtacgagtggcgtagcccctacggcctcacgccacgtggccgcaaccgcagcaccgtcttctcctactcctcagccctcaacctgtgctacgccatcctcttcagacgcaccgtgtccagcaagacgcccaagtgccccacgggccgcctgctcatgaacctctgggccatcttctgcctgctggtgctgtccagctacacggccaacctggctgccgtcatggtcggggacaagaccttcgaggagctgtcggggatccacgaccccaagctgcaccacccggcgcagggcttccgcttcggcaccgtgtgggagagcagcgccgaggcgtacatcaagaagagcttccccgacatgcacgcacacatgcggcgccacagcgcgcccaccacgccccgcggcgtcgccatgctcacgagcgacccccccaagctcaacgccttcatcatggacaagtcgctcctggactacgaggtctccatcgacgccgactgcaaactgctgaccgtgggaaagcccttcgccattgagggctatgggatcggactgccccagaactcgccgctcacctccaacctgtccgagttcatcagccgctacaagtcctccggcttcatcgacctgctccacgacaagtggtacaagatggtgccttgcggcaagcgggtctttgcggttacagagaccctgcagatgagcatctaccacttcgcgggcctcttcgtgttgctgtgcctgggcctgggcagcgctctgctcagctcgctgggcgagcacgccttcttccgcctggcgctgccgcgcatccgcaaggggagcaggctgcagtactggctgcacaccagccagaaaatccaccgcgccctcaacacggagccaccagaggggtcgaaggaggagacggcagaggcggagcccagcggccccgaggtggagcagcagcagcagcagcaggaccagccaacggctccggagggctggaaacgggcgcgccgggccgtggacaaggagcgccgcgtgcgcttcctgctggagcccgccgtggttgtggcacccgaagcggacgcggaggcggaggctgcgccgcgagagggccccgtctggctgtgctcctacggccgcccgcccgccgcaaggcccacgggggccccccagcccggggagctgcaggagctggagcgccgcatcgaagtcgcgcgtgagcggctccgccaggccctggtgcggcgcggccagctcctggcacagctcggggacagcgcacgtcaccggcctcggcgcttgcttcaggccagagcggcccccgcggaggccccaccacactctggccgaccggggagccaggaatgaggcggcagccgggccgtttgggctcaagacacacacacagcgcagtgagccgctgtcaacagacagtttattctatatacaaacacaattttgtacactgcaattaaatagaatggaatgagcgctcctc

SEQ ID NO: 137520 - DNA, 6622 bp, Homo sapiens
  Payload ID: 6925
  Gene Symbol: GRM1
  Gene Name: glutamate receptor, metabotropic 1
  Uniprot ID: Q13255
  ENST ID: ENST00000282753
  CDS Start-End: 236-3820
gaattcccttacaaacgcctccagcttgtagaggcggtcgtggaggacccagaggaggagacgaaggggaaggaggcggtggtggaggaggcaaaggccttggacgaccattgttggcgaggggcaccactccgggagaggcggcgctgggcgtcttgggggtgcgcgccgggagcctgcagcgggaccagcgtgggaacgcggctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaattctaatggcaagtctgtgtcatggtctgaaccaggtggaggacaggtgcccaagggacagcatatgtggcaccgcctctctgtgcacgtgaagaccaatgagacggcctgcaaccaaacagccgtcatcaagcccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgtcccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctcccccgtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctgggagtggggggcctcgtcgggaggacaggagaccgctgctgctgctgccgctactgctgctgctgccttaagtaggaagagagggaaggacaccaagcaaaaaatgttccaggccaggattcggattcttgaattactcgaagccttctctgggaagaaagggaattctgacaaagcacaattccatatggtatgtaacttttatcacaaatcaaatagtgacatcacaaacataatgtcctcttttgcacaattgtgcatagatatatatatgcccacacacactgggccatgcttgccaaggaacagcccacgtggacatgccagtcggatcatgagttcacctgatggcattcggagtgagctggtggagccagacagagcaggtgcggggaagggaagggcccaggccagacccatcccaaacggatgatgggatgatgggacagcagctccttgctcagaagcccttctccccgctgggctgacagactcctcatcttcaggagactcaggaatggagcggcacaggggtctctcttcatccactgcaacccatccagtgccagctttgagattgcacttgaagaaaggtgcatggaccccctgctgctctgcagattccctttatttaggaaaacaggaataagagcaaaattatcaccaaaaagtgcttcatcaggcgtgctacaggaggaaggagctagaaatagaacaatccatcagcatgagactttgaaaaaaaaacacatgatcagcttctcatgttccatattcacttattggcgatttggggaaaaggccggaacaagagattgttacgagagtggcagaaacccttttgtagattgacttgtgtttgtgccaagcgggctttccattgaccttcagttaaagaacaaaccatgtgacaaaattgttaccttccacttactgtagcaaataatacctacaagttgaacttctaagatgcgtatatgtacaatttggtgccattatttctcctacgtattagagaaacaaatccatctttgaatctaatggtgtactcatagcaactattactggtttaaatgacaaataattctatcctattgtcactgaagtccttgtaactagcgagtgaatgtgttcctgtgtccttgtatatgtgcgatcgtaaaatttgtgcaatgtaatgtcaaattgactggtcaatgtcaacctagtagtcaatctaactgcaattagaaattgtcttttgaatatactatatatattttttatgttccaataatgttttgtacatcattgtcatcaatatctacagaagctctttgacggtttgaatactatggctcaaggttttcatatgcagctcggatggacatttttcttctaagatggaacttatttttcagatattttctgatgtggagatatgttattaatgaagtggtttgaaaatttgttatattaaaagtgcacaaaaactgagagtgaaaataaaaggtacattttataagcttgcacacattattaacacataagattgaacaaagcatttagattattccaggttatatcatttttttaaagattttccacagctacttgagtgtctaacatacagtaacatctaactcagctaataatttgtaaaatctttatcaatcacattttgccttcttttaatttttatgttcatggacttttattcctgtgtcttggctgtcataactttttatttctgctatttgctgttgtgtaatatccatggacatgtaatccacttactccatctttacaatccctttttaccaccaataaaaggatttttcttgctgttttgatttcttctattatttgtggaatgaattataccccccttaaatatctttgtttatgccttatgttcagtcatattttaatatgcttccttcatattgaagctgctgatttctcagccaaaaatcatcttagaatctttaaatatccattgcatcatttgttcagaatttaacatccattccaatgttggaggcttgtattacttatatttcatcatattctattgccaagtttagtcagttccacaccaagaatgaactgcatttcctttaaaaattattttaaaacacctttattgaaaagatctcatgactgagatgtggactttggttccatgttttcattgtaagaaagcagagagcggaaaatcaatggctccagtgattaatagatgggtttttagtaattgacaaattcatgagggaaagcatatgatctctttattagtgaatcatgcttattttttactcttaatgccactaatatacatccctaatatcacagggcttgtgcattcagatttttaaaaaattaggatagataaggaaacaacttatattcaagtgtaagatgatatcaggttggtctaagacttttggtgaacacgttcattcaactgtgatcactttattactctgaatgcctactattatcctgattatggggtctcctgaataaatagagtattagtccttatgtcatcattgttcaaaattggagatgtacacatacataccctataccaagagggccgaaactcttcaccttgatgtatgttctgatacaagttgttcagcttcttgtaaatgtgttttccttcggcttgttactgccttttgtcaaataatcttgacaatgctgtataataaatattttctatttatt

SEQ ID NO: 137521 - DNA, 3874 bp, Homo sapiens
  Payload ID: 6925
  Gene Symbol: GRM1
  Gene Name: glutamate receptor, metabotropic 1
  Uniprot ID: Q13255
  ENST ID: ENST00000355289
  CDS Start-End: 236-2962
gaattcccttacaaacgcctccagcttgtagaggcggtcgtggaggacccagaggaggagacgaaggggaaggaggcggtggtggaggaggcaaaggccttggacgaccattgttggcgaggggcaccactccgggagaggcggcgctgggcgtcttgggggtgcgcgccgggagcctgcagcgggaccagcgtgggaacgcggctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaagtggaggacaggtgcccaagggacagcatatgtggcaccgcctctctgtgcacgtgaagaccaatgagacggcctgcaaccaaacagccgtcatcaagcccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgtcccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctcccccgtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctggg

SEQ ID NO: 137522 - DNA, 6754 bp, Homo sapiens
  Payload ID: 6925
  Gene Symbol: GRM1
  Gene Name: glutamate receptor, metabotropic 1
  Uniprot ID: Q13255
  ENST ID: ENST00000361719
  CDS Start-End: 368-3952
caggtactcaggtatgtctcaagtccatgtcctccaaacagactcagcatctagctcaccgctgccaacacgacttccactgtactcttgatcaatttaccttgatgcactaccggtgaagaacggggactcgaattcccttacaaacgcctccagcttgtagaggcggtcgtggaggacccagaggaggagacgaaggggaaggaggcggtggtggaggaggcaaaggccttggacgaccattgttggcgaggggcaccactccgggagaggcggcgctgggcgtcttgggggtgcgcgccgggagcctgcagcgggaccagcgtgggaacgcggctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaattctaatggcaagtctgtgtcatggtctgaaccaggtggaggacaggtgcccaagggacagcatatgtggcaccgcctctctgtgcacgtgaagaccaatgagacggcctgcaaccaaacagccgtcatcaagcccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgtcccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctcccccgtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctgggagtggggggcctcgtcgggaggacaggagaccgctgctgctgctgccgctactgctgctgctgccttaagtaggaagagagggaaggacaccaagcaaaaaatgttccaggccaggattcggattcttgaattactcgaagccttctctgggaagaaagggaattctgacaaagcacaattccatatggtatgtaacttttatcacaaatcaaatagtgacatcacaaacataatgtcctcttttgcacaattgtgcatagatatatatatgcccacacacactgggccatgcttgccaaggaacagcccacgtggacatgccagtcggatcatgagttcacctgatggcattcggagtgagctggtggagccagacagagcaggtgcggggaagggaagggcccaggccagacccatcccaaacggatgatgggatgatgggacagcagctccttgctcagaagcccttctccccgctgggctgacagactcctcatcttcaggagactcaggaatggagcggcacaggggtctctcttcatccactgcaacccatccagtgccagctttgagattgcacttgaagaaaggtgcatggaccccctgctgctctgcagattccctttatttaggaaaacaggaataagagcaaaattatcaccaaaaagtgcttcatcaggcgtgctacaggaggaaggagctagaaatagaacaatccatcagcatgagactttgaaaaaaaaacacatgatcagcttctcatgttccatattcacttattggcgatttggggaaaaggccggaacaagagattgttacgagagtggcagaaacccttttgtagattgacttgtgtttgtgccaagcgggctttccattgaccttcagttaaagaacaaaccatgtgacaaaattgttaccttccacttactgtagcaaataatacctacaagttgaacttctaagatgcgtatatgtacaatttggtgccattatttctcctacgtattagagaaacaaatccatctttgaatctaatggtgtactcatagcaactattactggtttaaatgacaaataattctatcctattgtcactgaagtccttgtaactagcgagtgaatgtgttcctgtgtccttgtatatgtgcgatcgtaaaatttgtgcaatgtaatgtcaaattgactggtcaatgtcaacctagtagtcaatctaactgcaattagaaattgtcttttgaatatactatatatattttttatgttccaataatgttttgtacatcattgtcatcaatatctacagaagctctttgacggtttgaatactatggctcaaggttttcatatgcagctcggatggacatttttcttctaagatggaacttatttttcagatattttctgatgtggagatatgttattaatgaagtggtttgaaaatttgttatattaaaagtgcacaaaaactgagagtgaaaataaaaggtacattttataagcttgcacacattattaacacataagattgaacaaagcatttagattattccaggttatatcatttttttaaagattttccacagctacttgagtgtctaacatacagtaacatctaactcagctaataatttgtaaaatctttatcaatcacattttgccttcttttaatttttatgttcatggacttttattcctgtgtcttggctgtcataactttttatttctgctatttgctgttgtgtaatatccatggacatgtaatccacttactccatctttacaatccctttttaccaccaataaaaggatttttcttgctgttttgatttcttctattatttgtggaatgaattataccccccttaaatatctttgtttatgccttatgttcagtcatattttaatatgcttccttcatattgaagctgctgatttctcagccaaaaatcatcttagaatctttaaatatccattgcatcatttgttcagaatttaacatccattccaatgttggaggcttgtattacttatatttcatcatattctattgccaagtttagtcagttccacaccaagaatgaactgcatttcctttaaaaattattttaaaacacctttattgaaaagatctcatgactgagatgtggactttggttccatgttttcattgtaagaaagcagagagcggaaaatcaatggctccagtgattaatagatgggtttttagtaattgacaaattcatgagggaaagcatatgatctctttattagtgaatcatgcttattttttactcttaatgccactaatatacatccctaatatcacagggcttgtgcattcagatttttaaaaaattaggatagataaggaaacaacttatattcaagtgtaagatgatatcaggttggtctaagacttttggtgaacacgttcattcaactgtgatcactttattactctgaatgcctactattatcctgattatggggtctcctgaataaatagagtattagtccttatgtcatcattgttcaaaattggagatgtacacatacataccctataccaagagggccgaaactcttcaccttgatgtatgttctgatacaagttgttcagcttcttgtaaatgtgttttccttcggcttgttactgccttttgtcaaataatcttgacaatgctgtataataaatattttctatttatt

SEQ ID NO: 137523 - DNA, 6836 bp, Homo sapiens
  Payload ID: 6925
  Gene Symbol: GRM1
  Gene Name: glutamate receptor, metabotropic 1
  Uniprot ID: Q13255
  ENST ID: ENST00000492807
  CDS Start-End: 368-3088
caggtactcaggtatgtctcaagtccatgtcctccaaacagactcagcatctagctcaccgctgccaacacgacttccactgtactcttgatcaatttaccttgatgcactaccggtgaagaacggggactcgaattcccttacaaacgcctccagcttgtagaggcggtcgtggaggacccagaggaggagacgaaggggaaggaggcggtggtggaggaggcaaaggccttggacgaccattgttggcgaggggcaccactccgggagaggcggcgctgggcgtcttgggggtgcgcgccgggagcctgcagcgggaccagcgtgggaacgcggctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaagaagaggcagccagaattctcgcccaccagccaatgtccgtcggcacatgtgcagctttgaaaacccccacactgcagtgaatgtttctaatggcaagtctgtgtcatggtctgaaccaggtggaggacaggtgcccaagggacagcatatgtggcaccgcctctctgtgcacgtgaagaccaatgagacggcctgcaaccaaacagccgtcatcaagcccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgtcccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctcccccgtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctgggagtggggggcctcgtcgggaggacaggagaccgctgctgctgctgccgctactgctgctgctgccttaagtaggaagagagggaaggacaccaagcaaaaaatgttccaggccaggattcggattcttgaattactcgaagccttctctgggaagaaagggaattctgacaaagcacaattccatatggtatgtaacttttatcacaaatcaaatagtgacatcacaaacataatgtcctcttttgcacaattgtgcatagatatatatatgcccacacacactgggccatgcttgccaaggaacagcccacgtggacatgccagtcggatcatgagttcacctgatggcattcggagtgagctggtggagccagacagagcaggtgcggggaagggaagggcccaggccagacccatcccaaacggatgatgggatgatgggacagcagctccttgctcagaagcccttctccccgctgggctgacagactcctcatcttcaggagactcaggaatggagcggcacaggggtctctcttcatccactgcaacccatccagtgccagctttgagattgcacttgaagaaaggtgcatggaccccctgctgctctgcagattccctttatttaggaaaacaggaataagagcaaaattatcaccaaaaagtgcttcatcaggcgtgctacaggaggaaggagctagaaatagaacaatccatcagcatgagactttgaaaaaaaaacacatgatcagcttctcatgttccatattcacttattggcgatttggggaaaaggccggaacaagagattgttacgagagtggcagaaacccttttgtagattgacttgtgtttgtgccaagcgggctttccattgaccttcagttaaagaacaaaccatgtgacaaaattgttaccttccacttactgtagcaaataatacctacaagttgaacttctaagatgcgtatatgtacaatttggtgccattatttctcctacgtattagagaaacaaatccatctttgaatctaatggtgtactcatagcaactattactggtttaaatgacaaataattctatcctattgtcactgaagtccttgtaactagcgagtgaatgtgttcctgtgtccttgtatatgtgcgatcgtaaaatttgtgcaatgtaatgtcaaattgactggtcaatgtcaacctagtagtcaatctaactgcaattagaaattgtcttttgaatatactatatatattttttatgttccaataatgttttgtacatcattgtcatcaatatctacagaagctctttgacggtttgaatactatggctcaaggttttcatatgcagctcggatggacatttttcttctaagatggaacttatttttcagatattttctgatgtggagatatgttattaatgaagtggtttgaaaatttgttatattaaaagtgcacaaaaactgagagtgaaaataaaaggtacattttataagcttgcacacattattaacacataagattgaacaaagcatttagattattccaggttatatcatttttttaaagattttccacagctacttgagtgtctaacatacagtaacatctaactcagctaataatttgtaaaatctttatcaatcacattttgccttcttttaatttttatgttcatggacttttattcctgtgtcttggctgtcataactttttatttctgctatttgctgttgtgtaatatccatggacatgtaatccacttactccatctttacaatccctttttaccaccaataaaaggatttttcttgctgttttgatttcttctattatttgtggaatgaattataccccccttaaatatctttgtttatgccttatgttcagtcatattttaatatgcttccttcatattgaagctgctgatttctcagccaaaaatcatcttagaatctttaaatatccattgcatcatttgttcagaatttaacatccattccaatgttggaggcttgtattacttatatttcatcatattctattgccaagtttagtcagttccacaccaagaatgaactgcatttcctttaaaaattattttaaaacacctttattgaaaagatctcatgactgagatgtggactttggttccatgttttcattgtaagaaagcagagagcggaaaatcaatggctccagtgattaatagatgggtttttagtaattgacaaattcatgagggaaagcatatgatctctttattagtgaatcatgcttattttttactcttaatgccactaatatacatccctaatatcacagggcttgtgcattcagatttttaaaaaattaggatagataaggaaacaacttatattcaagtgtaagatgatatcaggttggtctaagacttttggtgaacacgttcattcaactgtgatcactttattactctgaatgcctactattatcctgattatggggtctcctgaataaatagagtattagtccttatgtcatcattgttcaaaattggagatgtacacatacataccctataccaagagggccgaaactcttcaccttgatgtatgttctgatacaagttgttcagcttcttgtaaatgtgttttccttcggcttgttactgccttttgtcaaataatcttgacaatgctgtataataaatattttctattt

SEQ ID NO: 137524 - DNA, 3756 bp, Homo sapiens
  Payload ID: 6925
  Gene Symbol: GRM1
  Gene Name: glutamate receptor, metabotropic 1
  Uniprot ID: Q13255
  ENST ID: ENST00000507907
  CDS Start-End: 33-2753
gctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaagaagaggcagccagaattctcgcccaccagccaatgtccgtcggcacatgtgcagctttgaaaacccccacactgcagtgaatgtgtggaggacaggtgcccaagggacagcatatgtggcaccgcctctctgtgcacgtgaagaccaatgagacggcctgcaaccaaacagccgtcatcaagcccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgtcccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctcccccgtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctggg

SEQ ID NO: 137525 - DNA, 2993 bp, Homo sapiens
  Payload ID: 6926
  Gene Symbol: GRM2
  Gene Name: glutamate receptor, metabotropic 2
  ENST ID: ENST00000296479
  CDS Start-End: 217-1524
agcgagcgagcgagcgggagccggagcctcgcgccccccgctccactccgattctctccgcgccagagccagcgcgccaggagctgggtcccttcgcatctctcttcttgtctgtcctttcctggtccctgtttcctcctctctttgccttcgctgcttctaatctcatcccctggagacccaggtctgcgggacccatccatcccctttggggccatgggatcgctgcttgcgctcctggcactgctgctgctgtggggtgctgtggctgagggcccagccaagaaggtgctgaccctggagggagacttggtgctgggtgggctgttcccagtgcaccagaagggcggcccagcagaggactgtggtcctgtcaatgagcaccgtggcatccagcgcctggaggccatgctttttgcactggaccgcatcaaccgtgacccgcacctgctgcctggcgtgcgcctgggtgcacacatcctcgacagttgctccaaggacacacatgcgctggagcaggcactggactttgtgcgtgcctcactcagccgtggtgctgatggctcacgccacatctgccccgacggctcttatgcgacccatggtgatgctcccactgccatcactggtgttattggcggttcctacagtgatgtctccatccaggtggccaacctcttgaggctatttcagatcccacagattagctacgcctctaccagtgccaagctgagtgacaagtcccgctatgactactttgcccgcacagtgcctcctgacttcttccaagccaaggccatggctgagattctccgcttcttcaactggacctatgtgtccactgtggcgtctgagggcgactatggcgagacaggcattgaggcctttgagctagaggctcgtgcccgcaacatctgtgtggccacctcggagaaagtgggccgtgccatgagccgcgcggcctttgagggtgtggtgcgagccctgctgcagaagcccagtgcccgcgtggctgtcctgttcacccgttctgaggatgcccgggagctgcttgctgccagccagcgcctcaatgccagcttcacctgggtggccagtgatggttggggggccctggagagtgtggtggcaggcagtgagggggctgctgagggtgctatcaccatcgagctggcctcctaccccatcagtgactttgcctcctacttccagagcctggacccttggaacaacagccggaacccctggttccgtgaattctgggagcagaggttccgctgcagcttccggcagcgagactgcgcagcccactctctccgggctgtgccctttgagcaggagtccaagatcatgtttgtggtcaatgcagtgtacgccatggcccatgcgctccacaacatgcaccgtgccctctgccccaacaccacccggctctgtgacgcgatgcggccagttaacgggcgccgcctctacaaggactttgtgctcaacgtcaagtttgatggtgacctgaaagtctcctgaaatcaaaagttattttaataagagtgccagctttaagagaaatgactgctgcagatcatcactatgcttcaggaagaatcaccgtgggaacagtgggagacaaagcttggaagccctggcccagggttaagatgaagaccccctttcgcccagctgacacccacaatgaggtccgctttgaccgctttggtgatggtattggccgctacaacatcttcacctatctgcgtgcaggcagtgggcgctatcgctaccagaaggtgggctactgggcagaaggcttgactctggacaccagcctcatcccatgggcctcaccctcagccggccccctgcccgcctctcgctgcagtgagccctgcctccagaatgaggtgaagagtgtgcagccgggcgaagtctgctgctggctctgcattccgtgccagccctatgagtaccgattggacgaattcacttgcgctgattgtggcctgggctactggcccaatgccagcctgactggctgcttcgaactgccccaggagtacatccgctggggcgatgcctgggctgtgggacctgtcaccatcgcctgcctcggtgccctggccaccctctttgtgctgggtgtctttgtgcggcacaatgccacaccagtggtcaaggcctcaggtcgggagctctgctacatcctgctgggtggtgtcttcctctgctactgcatgaccttcatcttcattgccaagccatccacggcagtgtgtaccttacggcgtcttggtttgggcactgccttctctgtctgctactcagccctgctcaccaagaccaaccgcattgcacgcatcttcggtggggcccgggagggtgcccagcggccacgcttcatcagtcctgcctcacaggtggccatctgcctggcacttatctcgggccagctgctcatcgtggtcgcctggctggtggtggaggcaccgggcacaggcaaggagacagcccccgaacggcgggaggtggtgacactgcgctgcaaccaccgcgatgcaagtatgttgggctcgctggcctacaatgtgctcctcatcgcgctctgcacgctttatgccttcaagactcgcaagtgccccgaaaacttcaacgaggccaagttcattggcttcaccatgtacaccacctgcatcatctggctggcattcctgcccatcttctatgtcacctccagtgactaccgggtacagaccaccaccatgtgcgtgtcagtcagcctcagcggctccgtggtgcttggctgcctctttgcgcccaagctgcacatcatcctcttccagccgcagaagaacgtggttagccaccgggcacccaccagccgctttggcagtgctgctgccagggccagctccagccttggccaagggtctggctcccagtttgtccccactgtttgcaatggccgtgaggtggtggactcgacaacgtcatcgctttga

SEQ ID NO: 137526 - DNA, 3151 bp, Homo sapiens
  Payload ID: 6926
  Gene Symbol: GRM2
  Gene Name: glutamate receptor, metabotropic 2
  Uniprot ID: Q14416
  ENST ID: ENST00000395052
  CDS Start-End: 235-2853
gcgcagagccagcgagccagcgagcgagcgagcgggagccggagcctcgcgccccccgctccactccgattctctccgcgccagagccagcgcgccaggagctgggtcccttcgcatctctcttcttgtctgtcctttcctggtccctgtttcctcctctctttgccttcgctgcttctaatctcatcccctggagacccaggtctgcgggacccatccatcccctttggggccatgggatcgctgcttgcgctcctggcactgctgctgctgtggggtgctgtggctgagggcccagccaagaaggtgctgaccctggagggagacttggtgctgggtgggctgttcccagtgcaccagaagggcggcccagcagaggactgtggtcctgtcaatgagcaccgtggcatccagcgcctggaggccatgctttttgcactggaccgcatcaaccgtgacccgcacctgctgcctggcgtgcgcctgggtgcacacatcctcgacagttgctccaaggacacacatgcgctggagcaggcactggactttgtgcgtgcctcactcagccgtggtgctgatggctcacgccacatctgccccgacggctcttatgcgacccatggtgatgctcccactgccatcactggtgttattggcggttcctacagtgatgtctccatccaggtggccaacctcttgaggctatttcagatcccacagattagctacgcctctaccagtgccaagctgagtgacaagtcccgctatgactactttgcccgcacagtgcctcctgacttcttccaagccaaggccatggctgagattctccgcttcttcaactggacctatgtgtccactgtggcgtctgagggcgactatggcgagacaggcattgaggcctttgagctagaggctcgtgcccgcaacatctgtgtggccacctcggagaaagtgggccgtgccatgagccgcgcggcctttgagggtgtggtgcgagccctgctgcagaagcccagtgcccgcgtggctgtcctgttcacccgttctgaggatgcccgggagctgcttgctgccagccagcgcctcaatgccagcttcacctgggtggccagtgatggttggggggccctggagagtgtggtggcaggcagtgagggggctgctgagggtgctatcaccatcgagctggcctcctaccccatcagtgactttgcctcctacttccagagcctggacccttggaacaacagccggaacccctggttccgtgaattctgggagcagaggttccgctgcagcttccggcagcgagactgcgcagcccactctctccgggctgtgccctttgagcaggagtccaagatcatgtttgtggtcaatgcagtgtacgccatggcccatgcgctccacaacatgcaccgtgccctctgccccaacaccacccggctctgtgacgcgatgcggccagttaacgggcgccgcctctacaaggactttgtgctcaacgtcaagtttgatgccccctttcgcccagctgacacccacaatgaggtccgctttgaccgctttggtgatggtattggccgctacaacatcttcacctatctgcgtgcaggcagtgggcgctatcgctaccagaaggtgggctactgggcagaaggcttgactctggacaccagcctcatcccatgggcctcaccctcagccggccccctgcccgcctctcgctgcagtgagccctgcctccagaatgaggtgaagagtgtgcagccgggcgaagtctgctgctggctctgcattccgtgccagccctatgagtaccgattggacgaattcacttgcgctgattgtggcctgggctactggcccaatgccagcctgactggctgcttcgaactgccccaggagtacatccgctggggcgatgcctgggctgtgggacctgtcaccatcgcctgcctcggtgccctggccaccctctttgtgctgggtgtctttgtgcggcacaatgccacaccagtggtcaaggcctcaggtcgggagctctgctacatcctgctgggtggtgtcttcctctgctactgcatgaccttcatcttcattgccaagccatccacggcagtgtgtaccttacggcgtcttggtttgggcactgccttctctgtctgctactcagccctgctcaccaagaccaaccgcattgcacgcatcttcggtggggcccgggagggtgcccagcggccacgcttcatcagtcctgcctcacaggtggccatctgcctggcacttatctcgggccagctgctcatcgtggtcgcctggctggtggtggaggcaccgggcacaggcaaggagacagcccccgaacggcgggaggtggtgacactgcgctgcaaccaccgcgatgcaagtatgttgggctcgctggcctacaatgtgctcctcatcgcgctctgcacgctttatgccttcaagactcgcaagtgccccgaaaacttcaacgaggccaagttcattggcttcaccatgtacaccacctgcatcatctggctggcattcctgcccatcttctatgtcacctccagtgactaccgggtacagaccaccaccatgtgcgtgtcagtcagcctcagcggctccgtggtgcttggctgcctctttgcgcccaagctgcacatcatcctcttccagccgcagaagaacgtggttagccaccgggcacccaccagccgctttggcagtgctgctgccagggccagctccagccttggccaagggtctggctcccagtttgtccccactgtttgcaatggccgtgaggtggtggactcgacaacgtcatcgctttgaagaccccatactcccgccctgacacagctgctcctgggaacctagtgcagacccacgtccagggccaggaggaagttggctggagcactgcaataatttattacccaccctatgtctgcccccaaagtcacttacccacctccttaccccagctcttcagactcagaagtcaggagccttggccaggagcctctgcagtggccactaactgcccttgtagctgtgtttcctcctggccaggcccagggctcagagaggagcaagccagggttcactctgccctggacccgggtggctg

SEQ ID NO: 137527 - DNA, 590 bp, Homo sapiens
  Payload ID: 6926
  Gene Symbol: GRM2
  Gene Name: glutamate receptor, metabotropic 2
  ENST ID: ENST00000419928
  CDS Start-End: 381-590
ctttctgtctgtgcctccgtctttgtctcaacctctcaggcttgctcgctccctgcccagattttgtggcccaggctcctggctgtctgactccgggtttctgtccccttcctgcctctgagcttccgtctgggcctcccctctgggagacttgcgacttgaccagttttggcttcagcccccatctgggtccctgtctccatctgtgctggtcttcctccctgcttctccctcgcttgcctgggagctgggtcccttcgcatctctcttcttgtctgtcctttcctggtccctgtttcctcctctctttgccttcgctgcttctaatctcatcccctggagacccaggtctgcgggacccatccatcccctttggggccatgggatcgctgcttgcgctcctggcactgctgctgctgtggggtgctgtggctgagggcccagccaagaaggtgctgaccctggagggagacttggtgctgggtgggctgttcccagtgcaccagaagggcggcccagcagaggactgtggtcctgtcaatgagcaccgtggcatccagcgcctggaggccatgctttttgcactggac

SEQ ID NO: 137528 - DNA, 2064 bp, Homo sapiens
  Payload ID: 6926
  Gene Symbol: GRM2
  Gene Name: glutamate receptor, metabotropic 2
  ENST ID: ENST00000442933
  CDS Start-End: 140-1924
caggagctgggtcccttcgcatctctcttcttgtctgtcctttcctggtccctgtttcctcctctctttgccttcgctgcttctaatctcatcccctggagacccaggtctgcgggacccatccatcccctttggggccatgggatcgctgcttgcgctcctggcactgctgctgctgtggggtgctgtggctgagggcccagccaagaaggtgctgaccctggagggagacttggtgctgggtgggctgttcccagtgcaccagaagggcggcccagcagaggactgtggtcctgtcaatgagcaccgtggcatccagcgcctggaggccatgctttttgcactggaccgcatcaaccgtgacccgcacctgctgcctggcgtgcgcctgggtgcacacatcctcgacagttgctccaaggacacacatgcgctggagcaggcactggactttgtgcgtgcctcactcagccgtggtgctgatggctcacgccacatctgccccgacggctcttatgcgacccatggtgatgctcccactgccatcactggtgttattggcggttcctacagtgatgtctccatccaggtggccaacctcttgaggctatttcagatcccacagattagctacgcctctaccagtgccaagctgagtgacaagtcccgctatgactactttgcccgcacagtgcctcctgacttcttccaagccaaggccatggctgagattctccgcttcttcaactggacctatgtgtccactgtggcgtctgagggcgactatggcgagacaggcattgaggcctttgagctagaggctcgtgcccgcaacatctgtgtggccacctcggagaaagtgggccgtgccatgagccgcgcggcctttgagggtgtggtgcgagccctgctgcagaagcccagtgcccgcgtggctgtcctgttcacccgttctgaggatgcccgggagctgcttgctgccagccagcgcctcaatgccagcttcacctgggtggccagtgatggttggggggccctggagagtgtggtggcaggcagtgagggggctgctgagggtgctatcaccatcgagctggcctcctaccccatcagtgactttgcctcctacttccagagcctggacccttggaacaacagccggaacccctggttccgtgaattctgggagcagaggttccgctgcagcttccggcagcgagactgcgcagcccactctctccgggctgtgccctttgagcaggagtccaagatcatgtttgtggtcaatgcagtgtacgccatggcccatgcgctccacaacatgcaccgtgccctctgccccaacaccacccggctctgtgacgcgatgcggccagttaacgggcgccgcctctacaaggactttgtgctcaacgtcaagtttgatgccccctttcgcccagctgacacccacaatgaggtccgctttgaccgctttggtgatggtattggccgctacaacatcttcacctatctgcgtgcaggcagtgggcgctatcgctaccagaagactcgcaagtgccccgaaaacttcaacgaggccaagttcattggcttcaccatgtacaccacctgcatcatctggctggcattcctgcccatcttctatgtcacctccagtgactaccgggtacagaccaccaccatgtgcgtgtcagtcagcctcagcggctccgtggtgcttggctgcctctttgcgcccaagctgcacatcatcctcttccagccgcagaagaacgtggttagccaccgggcacccaccagccgctttggcagtgctgctgccagggccagctccagccttggccaagggtctggctcccagtttgtccccactgtttgcaatggccgtgaggtggtggactcgacaacgtcatcgctttgaagaccccatactcccgccctgacacagctgctcctgggaacctagtgcagacccacgtccagggccaggaggaagttggctggagcactgcaataatttattacccaccctatgtctgcccccaaagtcacttacccacc

SEQ ID NO: 137529 - DNA, 4268 bp, Homo sapiens
  Payload ID: 6927
  Gene Symbol: GRM3
  Gene Name: glutamate receptor, metabotropic 3
  Uniprot ID: Q14832
  ENST ID: ENST00000361669
  CDS Start-End: 1100-3739
gtgcagttgagtcgcgagtacggctgagctgcgtaccggcctccctggctctcacactccctctctgctcccgctctcctaatctcctctggcatgcggtcagccccctgcccagggaccacaggagagttcttgtaaggactgttagtccctgcttacctgaaagccaagcgctctagcagagctttaaagttggagccgccaccctccctaccgccccatgccccttcaccccactccgaaattcaccgacctttgcatgcactgcctaaggatttcagagtgaggcaaagcagtcggcaaatctaccctggcttttcgtataaaaatcctctcgtctaggtaccctggctcactgaagactctgcagatatacccttataagagggagggtgggggagggaaaagaacgagagagggaggaaagaatgaaaaggagaggatgccaggaggtccgtgcttctgccaagagtcccaattagatgcgacggcttcagcctggtcaaggtgaaggaaagttgcttccgcgcctaggaagtgggtttgcctgataagagaaggaggaggggactcggctgggaagagctcccctcccctccgcggaagaccactgggtcccctctttccccaacctcctccctctcttctactccacccctccgttttcccactccccactgactcggatgcctggatgttctgccaccgggcagtggtccagcgtgcagccgggagggggcaggggcagggggcactgtgacaggaagctgcgcgcacaagttggccatttcgagggcaaaataagttctcccttggatttggaaaggacaaagccagtaagctacctcttttgtgtcggatgaggaggaccaaccatgagccagagcccgggtgcaggctcaccgccgccgctgccaccgcggtcagctccagttcctgccaggagttgtcggtgcgaggaattttgtgacaggctctgttagtctgttcctcccttatttgaaggacaggccaaagatccagtttggaaatgagagaggactagcatgacacattggctccaccattgatatctcccagaggtacagaaacaggattcatgaagatgttgacaagactgcaagttcttaccttagctttgttttcaaagggatttttactctctttaggggaccataactttctaaggagagagattaaaatagaaggtgaccttgttttagggggcctgtttcctattaacgaaaaaggcactggaactgaagaatgtgggcgaatcaatgaagaccgagggattcaacgcctggaagccatgttgtttgctattgatgaaatcaacaaagatgattacttgctaccaggagtgaagttgggtgttcacattttggatacatgttcaagggatacctatgcattggagcaatcactggagtttgtcagggcatctttgacaaaagtggatgaagctgagtatatgtgtcctgatggatcctatgccattcaagaaaacatcccacttctcattgcaggggtcattggtggctcttatagcagtgtttccatacaggtggcaaacctgctgcggctcttccagatccctcagatcagctacgcatccaccagcgccaaactcagtgataagtcgcgctatgattactttgccaggaccgtgccccccgacttctaccaggccaaagccatggctgagatcttgcgcttcttcaactggacctacgtgtccacagtagcctccgagggtgattacggggagacagggatcgaggccttcgagcaggaagcccgcctgcgcaacatctgcatcgctacggcggagaaggtgggccgctccaacatccgcaagtcctacgacagcgtgatccgagaactgttgcagaagcccaacgcgcgcgtcgtggtcctcttcatgcgcagcgacgactcgcgggagctcattgcagccgccagccgcgccaatgcctccttcacctgggtggccagcgacggctggggcgcgcaggagagcatcatcaagggcagcgagcatgtggcctacggcgccatcaccctggagctggcctcccagcctgtccgccagttcgaccgctacttccagagcctcaacccctacaacaaccaccgcaacccctggttccgggacttctgggagcaaaagtttcagtgcagcctccagaacaaacgcaaccacaggcgcgtctgcgacaagcacctggccatcgacagcagcaactacgagcaagagtccaagatcatgtttgtggtgaacgcggtgtatgccatggcccacgctttgcacaaaatgcagcgcaccctctgtcccaacactaccaagctttgtgatgctatgaagatcctggatgggaagaagttgtacaaggattacttgctgaaaatcaacttcacggctccattcaacccaaataaagatgcagatagcatagtcaagtttgacacttttggagatggaatggggcgatacaacgtgttcaatttccaaaatgtaggtggaaagtattcctacttgaaagttggtcactgggcagaaaccttatcgctagatgtcaactctatccactggtcccggaactcagtccccacttcccagtgcagcgacccctgtgcccccaatgaaatgaagaatatgcaaccaggggatgtctgctgctggatttgcatcccctgtgaaccctacgaatacctggctgatgagtttacctgtatggattgtgggtctggacagtggcccactgcagacctaactggatgctatgaccttcctgaggactacatcaggtgggaagacgcctgggccattggcccagtcaccattgcctgtctgggttttatgtgtacatgcatggttgtaactgtttttatcaagcacaacaacacacccttggtcaaagcatcgggccgagaactctgctacatcttattgtttggggttggcctgtcatactgcatgacattcttcttcattgccaagccatcaccagtcatctgtgcattgcgccgactcgggctggggagttccttcgctatctgttactcagccctgctgaccaagacaaactgcattgcccgcatcttcgatggggtcaagaatggcgctcagaggccaaaattcatcagccccagttctcaggttttcatctgcctgggtctgatcctggtgcaaattgtgatggtgtctgtgtggctcatcctggaggccccaggcaccaggaggtatacccttgcagagaagcgggaaacagtcatcctaaaatgcaatgtcaaagattccagcatgttgatctctcttacctacgatgtgatcctggtgatcttatgcactgtgtacgccttcaaaacgcggaagtgcccagaaaatttcaacgaagctaagttcataggttttaccatgtacaccacgtgcatcatctggttggccttcctccctatattttatgtgacatcaagtgactacagagtgcagacgacaaccatgtgcatctctgtcagcctgagtggctttgtggtcttgggctgtttgtttgcacccaaggttcacatcatcctgtttcaaccccagaagaatgttgtcacacacagactgcacctcaacaggttcagtgtcagtggaactgggaccacatactctcagtcctctgcaagcacgtatgtgccaacggtgtgcaatgggcgggaagtcctcgactccaccacctcatctctgtgattgtgaattgcagttcagttcttgtgtttttagactgttagacaaaagtgctcacgtgcagctccagaatatggaaacagagcaaaagaacaaccctagtacctttttttagaaacagtacgataaattatttttgaggactgtatatagtgatgtgctagaactttctaggctgagtctagtgcccctattattaacaattcccccagaacatggaaataaccattgtttacagagctgagcattggtgacagggtctgacatggtcagtctactaaaaaacaaaaaaaaaaaacaaaaaaaaaaaaacaaaagaaaaaaataaaaatacggtggcaatattatgtaaccttttttcctatgaagttttttgtaggtccttgttgtaactaatttaggatgagtttctatgttgtatattaaagttacattatgtgtaacagattgattttctcagcacaaaataaaaagcatctgtattaatgtaaagatactgagaataaaaccttcaaggttttccagcatggtg

SEQ ID NO: 137530 - DNA, 528 bp, Homo sapiens
  Payload ID: 6927
  Gene Symbol: GRM3
  Gene Name: glutamate receptor, metabotropic 3
  ENST ID: ENST00000421579
  CDS Start-End: 268-528
agttcctgccaggagttgtcggtgcgaggtaagggtcccagaggaggacgtgtccctctggagggcgcccagccagggcgcggaagctcgggtgccgcgtggggcaggcgcagccgggaaagttgaggaattttgtgacaggctctgttagtctgttcctcccttatttgaaggacaggccaaagatccagtttggaaatgagagaggactagcatgacacattggctccaccattgatatctcccagaggtacagaaacaggattcatgaagatgttgacaagactgcaagttcttaccttagctttgttttcaaagggatttttactctctttaggggaccataactttctaaggagagagattaaaatagaaggtgaccttgttttagggggcctgtttcctattaacgaaaaaggcactggaactgaagaatgtgggcgaatcaatgaagaccgagggattcaacgcctggaagccatgttgtttgctattgatgaaatcaacaaagatgattacttgctacca

SEQ ID NO: 137531 - DNA, 1811 bp, Homo sapiens
  Payload ID: 6927
  Gene Symbol: GRM3
  Gene Name: glutamate receptor, metabotropic 3
  Uniprot ID: Q14832
  ENST ID: ENST00000439827
  CDS Start-End: 172-1785
tccagttcctgccaggagttgtcggtgcgaggaattttgtgacaggctctgttagtctgttcctcccttatttgaaggacaggccaaagatccagtttggaaatgagagaggactagcatgacacattggctccaccattgatatctcccagaggtacagaaacaggattcatgaagatgttgacaagactgcaagttcttaccttagctttgttttcaaagggatttttactctctttaggggaccataactttctaaggagagagattaaaatagaaggtgaccttgttttagggggcctgtttcctattaacgaaaaaggcactggaactgaagaatgtgggcgaatcaatgaagaccgagggattcaacgcctggaagccatgttgtttgctattgatgaaatcaacaaagatgattacttgctaccaggagtgaagttgggtgttcacattttggatacatgttcaagggatacctatgcattggagcaatcactggagtttgtcagggcatctttgacaaaagtggatgaagctgagtatatgtgtcctgatggatcctatgccattcaagaaaacatcccacttctcattgcaggggtcattggtggctcttatagcagtgtttccatacaggtggcaaacctgctgcggctcttccagatccctcagatcagctacgcatccaccagcgccaaactcagtgataagtcgcgctatgattactttgccaggaccgtgccccccgacttctaccaggccaaagccatggctgagatcttgcgcttcttcaactggacctacgtgtccacagtagcctccgagggtgattacggggagacagggatcgaggccttcgagcaggaagcccgcctgcgcaacatctgcatcgctacggcggagaaggtgggccgctccaacatccgcaagtcctacgacagcgtgatccgagaactgttgcagaagcccaacgcgcgcgtcgtggtcctcttcatgcgcagcgacgactcgcgggagctcattgcagccgccagccgcgccaatgcctccttcacctgggtggccagcgacggctggggcgcgcaggagagcatcatcaagggcagcgagcatgtggcctacggcgccatcaccctggagctggcctcccagcctgtccgccagttcgaccgctacttccagagcctcaacccctacaacaaccaccgcaacccctggttccgggacttctgggagcaaaagtttcagtgcagcctccagaacaaacgcaaccacaggcgcgtctgcgacaagcacctggccatcgacagcagcaactacgagcaagagtccaagatcatgtttgtggtgaacgcggtgtatgccatggcccacgctttgcacaaaatgcagcgcaccctctgtcccaacactaccaagctttgtgatgctatgaagatcctggatgggaagaagttgtacaaggattacttgctgaaaatcaacttcacgggtgcagacgacaaccatgtgcatctctgtcagcctgagtggctttgtggtcttgggctgtttgtttgcacccaaggttcacatcatcctgtttcaaccccagaagaatgttgtcacacacagactgcacctcaacaggttcagtgtcagtggaactgggaccacatactctcagtcctctgcaagcacgtatgtgccaacggtgtgcaatgggcgggaagtcctcgactccaccacctcatctctgtgattgtgaattgcagttcagttcttgtgtttttagactgttagacaaaagtgctcacgtgcagctccag

SEQ ID NO: 137532 - DNA, 770 bp, Homo sapiens
  Payload ID: 6927
  Gene Symbol: GRM3
  Gene Name: glutamate receptor, metabotropic 3
  ENST ID: ENST00000454217
  CDS Start-End: 256-770
tctttccccaacctcctccctctcttctactccacccctccgttttcccactccccactgactcggatgcctggatgttctgccaccgggcagtggtccagcgtgcagccgggagggggcaggggcagggggcactgtgacaggaagctgcgcgcacaagttggccatttcgagggcaaaataagttctcccttggatttggaaaggacaaagccagtaagctacctcttttgtgtcggatgaggaggaccaaccatgagccagagcccgggtgcaggctcaccgccgccgctgccaccgcggtcagctccagttcctgccaggagttgtcggtgcgaggtggcaaacctgctgcggctcttccagatccctcagatcagctacgcatccaccagcgccaaactcagtgataagtcgcgctatgattactttgccaggaccgtgccccccgacttctaccaggccaaagccatggctgagatcttgcgcttcttcaactggacctacgtgtccacagtagcctccgagggtgattacggggagacagggatcgaggccttcgagcaggaagcccgcctgcgcaacatctgcatcgctacggcggagaaggtgggccgctccaacatccgcaagtcctacgacagcgtgatccgagaactgttgcagaagcccaacgcgcgcgtcgtggtcctcttcatgcgcagcgacgactcgcgggagctcattgcagccgccagccgcgccaatgcctccttcacctgggtggccag

SEQ ID NO: 137533 - DNA, 491 bp, Homo sapiens
  Payload ID: 6927
  Gene Symbol: GRM3
  Gene Name: glutamate receptor, metabotropic 3
  ENST ID: ENST00000441140
  CDS Start-End: 248-491
acaataatcaagagactacttgttcataagaagaataggctgcaaatgtaacttctattgtcttatcttttcattttttcataatgcaaatatgaccaattaaaaatgaattttgtgacaggctctgttagtctgttcctcccttatttgaaggacaggccaaagatccagtttggaaatgagagaggactagcatgacacattggctccaccattgatatctcccagaggtacagaaacaggattcatgaagatgttgacaagactgcaagttcttaccttagctttgttttcaaagggatttttactctctttaggggaccataactttctaaggagagagattaaaatagaaggtgaccttgttttagggggcctgtttcctattaacgaaaaaggcactggaactgaagaatgtgggcgaatcaatgaagaccgagggattcaacgcctggaagccatgttgtttgctattgatgaaatcaacaaag

SEQ ID NO: 137534 - DNA, 3590 bp, Homo sapiens
  Payload ID: 6928
  Gene Symbol: GRM4
  Gene Name: glutamate receptor, metabotropic 4
  Uniprot ID: Q14833
  ENST ID: ENST00000374177
  CDS Start-End: 233-2623
aatcccagcgctttgctggaggatcgcttgagcccaggaattcaagaccagcctgggcaacatggcgagaccctgtctgtcccaaaacaaaaaaacagattttaattggtttgggatgcggcctggacacagggaaattttaaagctctctaggtaactccaatgtgcgtcgaggttgcgaaccgccggcctgtcacacagagggagctcaggagatgctgagagtgggaggatgccggcttgggagcctggagttgcagcttcctgcggctggcgcgcccctccttgctcccctctacgcctctgcatcgcaccccacccctgtaccccaccttcctcccaccaaggaaacctcacctgccgcctcccgcccaggtcctttggattttgccggtgtgtgtgggtgcgcacaagaggcccctccctgccaggagagcaggtgagcctggccgcgcacgaatccgagggggcggccgcccagctgggaagcagccctgaaatagacccccgccgcccccgctgcctccttccggaatctgctcagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgagaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacgaaaacaaatctcgagtgtgttgccaagtgctgcgtcctcctggtggcctctgtgtgtgtccctgtggcccgcagcctgcccgcctgccccgcccatctgccgtgtgtcttgcccgcctgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggtttt

SEQ ID NO: 137535 - DNA, 7275 bp, Homo sapiens
  Payload ID: 6928
  Gene Symbol: GRM4
  Gene Name: glutamate receptor, metabotropic 4
  ENST ID: ENST00000374181
  CDS Start-End: 502-3099
agtgacgcaccagggtgggagtagcgcgcccctctgcgtccctgtgctttgctgtacttttctgggtgtgtgttagggaggctatgttcctgaccctccccctctggggtgagaaggggtccccgccatgtcctcggggttggtaggaggagaggattggagctgttttctccttgatgccaagatacgccaagctaggagcattctgccctttccacagtcatccaccgagaacaggcctgcaggacgggacaaggatcagagccttcctgcaaccccggccactgcctgctgtctgtgggcctggactgtgcgggcaactgtgcttggcccgagtgacaaggaggtgggagagggtagcagcatgggctacgcggttggctgccctcagtccccctgctgctgaagctgccctgcccatgcccacccaggccgtggggccaggggcctgccagggctaggagtgggcctgccgttcatgggtctctagggatttccgagatgcctgggaagagaggcttgggctggtggtgggcccggctgcccctttgcctgctcctcagcctttacggcccctggatgccttcctccctgggaaagcccaaaggccaccctcacatgaattccatccgcatagatggggacatcacactgggaggcctgttcccggtgcatggccggggctcagagggcaagccctgtggagaacttaagaaggaaaagggcatccaccggctggaggccatgctgttcgccctggatcgcatcaacaacgacccggacctgctgcctaacatcacgctgggcgcccgcattctggacacctgctccagggacacccatgccctcgagcagtcgctgacctttgtgcaggcgctcatcgagaaggatggcacagaggtccgctgtggcagtggcggcccacccatcatcaccaagcctgaacgtgtggtgggtgtcatcggtgcttcagggagctcggtctccatcatggtggccaacatccttcgcctcttcaagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgagaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacgaaaacaaatctcgagtgtgttgccaagtgctgcgtcctcctggtggcctctgtgtgtgtccctgtggcccgcagcctgcccgcctgccccgcccatctgccgtgtgtcttgcccgcctgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggttttgcacccgggctccacatccactgagggtcctgccatgggaccacaggctcagcctgcagctggagggcttagacctagagggaagcgggaactgggctctggagacccagggcttgggggctgtggagactgctccctaggctgggatctagtgtggtgtggtgaggccttgggcatggaggggccagattcccaggtaaggggcagggacattgcaggaaattccaggaatcagcacctagtagtcccctaattagggggtatgctctgtcccctgccctgcagccctgggagggtaacatttctgccttgcctgtcctctgtctcacacccctcacacctgggactgcccttccacccctgcccccataacctgtgcctctctccttccagccaggaagtcctcttcttgagaagttagcttcccgggctgccagcactcatagccgtcccctcctgcttgtgttggctccaggctcgggtgctaagaagatgtgtgtctgtcctggagatcagtgtgttgttatgtgtccacgtgggcccacaagtgcacggcacaggcatggccgtgtggctgtgttggctgtgttggctgtgtgtctgtgtgcacgtccagcgcctccatgcgcatgcgtgcctgtcttgtttgcgtgtctgatcatctgtttgggccccggtggctcatgcagatgcctgtctcaggcccatggcgagtgttcacctcagctggcttccctggcaggttgggaggtgggaaacaggagcgcttaggggctgggctctggctggggtaaattatagagccagaaacacaatgaggccataggcagcagctggagcctgggctgcctgtgccgtcccctcctgccctgcccctgggtcctgcaccccctcccacctccaggctagctgacagcgctatggagcacagtggaagggactggaggaaccctaggcagggggccacgcagggacagagtatgagagtgtgtgtataactgaggctgggacattgaatcatgccaggtatgtcttctccatcagcccactcttactcctggcctgggcatctcacacatctgtgcataggaaatctcttcttccctggggtctgtgtgcagcacctagtagatgctcaataaatgtttgtgtgagggaaggagacaggaaaggaagtgtctcgctgatcatcttgcggaatggttcctaagacctctgcccaggaaagattccacccagtgctccagcccggtcaggcagaactaggttgccagatcaagggtatctcccaaaagcttccagggcagttgggggtgggggggtggggggtagggatggggaatgcagaagcgggtgcagccagctctcccccagggtgactctggcagcacccccatcctgggcaccctgcctgctctgtggctcacgcccctcctgaagtgactgatgctctgaggcccaaggctaggtccagggcagggcctgcaggggtttcatgctcagtccaggacttgcctaggtccccctacatctgtggggcccccatctaggttctaacaggagaatcacctctccaagggggatgctgcccctcggctccccttggctctcaggaggggccctcagggactaccagtcccctgccagtgggaagaaatagccctgccctcagggagcttccagtgtgatgggggagatacagcagactgtgtcccaaagtaaaatgactgttagaatgaggtgggtggaggagggaagccttgggtgggtgtgactttgggcatctgagcctggggtgcagaggtgggctctgtgggcctgaggtggacaggagggaaccaggccctagcaagacttttgccagctagacctgctgcagcagttgggagggtgggtgctgctggagtcctgggtccatcacctagaaggctcaggccagtgcagccagggctggggcccacagctggcctgggtgggacctgccctgatgcccatggcaggagggacgcctggcccttcacaattggcttggctgctcacctttgctctcatcctcaattattaatgactggagaaagctgctaagtatcttcagaatgttagatttcaacaagatggggggttcagggtccctggcaccctggatagggagccagcggcccctagagacctttgctgtgtgcagggggtatgtgctcacccccgtggcctcagcctcctcaatgtctgaatgaaggattgggctagcagacatcccaccccacagcacactttctaaccagcaggggaacttctagacaatagagacgctgggctccctccagaacactggacctgaacttctggggggagggctgggcacgggcatattttaaaagctccccagcagatgggccgtgcagtcaagtgggccaagagtggcaccagactttggggcttgtgaagtcaggagggagcaacagtgcccactcgagcttgcctggggctcaagcccaaggctgggctgctgccagcctgagcagacacccaggagcttccaggccagctggatgcacagggcacctttgtggaactcctaggaccctggggagacccacctcaggagcagagtctcaggtcccttccggctctgaggggctgttctgagctctaatgtcttatggtctgcccctcccatccttacttctcaggccctggaggcagaggcatagagccaggcaggacagaggtctcagtgggccacatgccagctgcccccacactgcctcagcctccaggcctccaaggggtcctggggagcccctgagaagatgctgagcctgcataaggctgggcgcccctctttctgacaccctcactggctccacggctcccccttcccatcccaggtttccatctgcccactgaacagggaggggaaactgaggcactcccctggcactgagggctccttctgtcatcctgcctgccctggatggtcctggctgcccctcagggcttggccctggcactgtgagcctcacagggctcagacccccacccccaacccagcactaaatggcactcggcaccagaatctcacttcagttggcaaaagcagcaattagcatgtaatgaggcttcttgctttatttttaggtaacctccaaggccctgcctgtgtaattcagcccgccattgctcggtggataattaaagcatgtcaccat

SEQ ID NO: 137536 - DNA, 2574 bp, Homo sapiens
  Payload ID: 6928
  Gene Symbol: GRM4
  Gene Name: glutamate receptor, metabotropic 4
  Uniprot ID: Q14833
  ENST ID: ENST00000455714
  CDS Start-End: 32-2350
aaatgccccagtccttccggctggctgcaagatggtgcaaactcttcccaagctatttccccatgatggcgccaagagaaaaaagaggacccttaggacttcagggccatgctttgggggtggaggacagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccac

SEQ ID NO: 137537 - DNA, 2983 bp, Homo sapiens
  Payload ID: 6928
  Gene Symbol: GRM4
  Gene Name: glutamate receptor, metabotropic 4
  Uniprot ID: Q14833
  ENST ID: ENST00000544773
  CDS Start-End: 364-2595
agctgcccccaagccttggcagcctgagggtgcccatggggagccctgtctccgcttggctccttgcagtctgtggggcacagcgttcccctggagagaggctgttccttgtgggctcttactgtccatactcccagcctgccctggggggaacttcctgctatctcctcacctccaggcctgagctggaggaaggctgggcagaggagagctgccaggcaagacagatggcctgcagcctgggccagggaggggcaccactttgatctctgatgccctggggactcacgggctgcaggtgctaccagcccagcaccccggcacagcggggaggctgaggcagacacacgctcctggagagacatgtcatgtaagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttg

SEQ ID NO: 137538 - DNA, 6670 bp, Homo sapiens
  Payload ID: 6928
  Gene Symbol: GRM4
  Gene Name: glutamate receptor, metabotropic 4
  Uniprot ID: Q14833
  ENST ID: ENST00000535756
  CDS Start-End: 155-2494
gcagtgcctgacacatcccagtctttcaccgtggtgcctgtggacagatgaggagactgaggctcacaaaggaggtgacttgcccaaggtcacacagcgaggcagcttctcacctatgggagttggactttgagccctccttggaaaagggggcatggctgtgccccttggggctccttgctgggcctctgccctgcctgcctgggctcctcccggcctcccccacagatcactgttgacaaggttactgagtcagcatgtaaaacctgcaaaaataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacgaaaacaaatctcgagtgtgttgccaagtgctgcgtcctcctggtggcctctgtgtgtgtccctgtggcccgcagcctgcccgcctgccccgcccatctgccgtgtgtcttgcccgcctgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggttttgcacccgggctccacatccactgagggtcctgccatgggaccacaggctcagcctgcagctggagggcttagacctagagggaagcgggaactgggctctggagacccagggcttgggggctgtggagactgctccctaggctgggatctagtgtggtgtggtgaggccttgggcatggaggggccagattcccaggtaaggggcagggacattgcaggaaattccaggaatcagcacctagtagtcccctaattagggggtatgctctgtcccctgccctgcagccctgggagggtaacatttctgccttgcctgtcctctgtctcacacccctcacacctgggactgcccttccacccctgcccccataacctgtgcctctctccttccagccaggaagtcctcttcttgagaagttagcttcccgggctgccagcactcatagccgtcccctcctgcttgtgttggctccaggctcgggtgctaagaagatgtgtgtctgtcctggagatcagtgtgttgttatgtgtccacgtgggcccacaagtgcacggcacaggcatggccgtgtggctgtgttggctgtgttggctgtgtgtctgtgtgcacgtccagcgcctccatgcgcatgcgtgcctgtcttgtttgcgtgtctgatcatctgtttgggccccggtggctcatgcagatgcctgtctcaggcccatggcgagtgttcacctcagctggcttccctggcaggttgggaggtgggaaacaggagcgcttaggggctgggctctggctggggtaaattatagagccagaaacacaatgaggccataggcagcagctggagcctgggctgcctgtgccgtcccctcctgccctgcccctgggtcctgcaccccctcccacctccaggctagctgacagcgctatggagcacagtggaagggactggaggaaccctaggcagggggccacgcagggacagagtatgagagtgtgtgtataactgaggctgggacattgaatcatgccaggtatgtcttctccatcagcccactcttactcctggcctgggcatctcacacatctgtgcataggaaatctcttcttccctggggtctgtgtgcagcacctagtagatgctcaataaatgtttgtgtgagggaaggagacaggaaaggaagtgtctcgctgatcatcttgcggaatggttcctaagacctctgcccaggaaagattccacccagtgctccagcccggtcaggcagaactaggttgccagatcaagggtatctcccaaaagcttccagggcagttgggggtgggggggtggggggtagggatggggaatgcagaagcgggtgcagccagctctcccccagggtgactctggcagcacccccatcctgggcaccctgcctgctctgtggctcacgcccctcctgaagtgactgatgctctgaggcccaaggctaggtccagggcagggcctgcaggggtttcatgctcagtccaggacttgcctaggtccccctacatctgtggggcccccatctaggttctaacaggagaatcacctctccaagggggatgctgcccctcggctccccttggctctcaggaggggccctcagggactaccagtcccctgccagtgggaagaaatagccctgccctcagggagcttccagtgtgatgggggagatacagcagactgtgtcccaaagtaaaatgactgttagaatgaggtgggtggaggagggaagccttgggtgggtgtgactttgggcatctgagcctggggtgcagaggtgggctctgtgggcctgaggtggacaggagggaaccaggccctagcaagacttttgccagctagacctgctgcagcagttgggagggtgggtgctgctggagtcctgggtccatcacctagaaggctcaggccagtgcagccagggctggggcccacagctggcctgggtgggacctgccctgatgcccatggcaggagggacgcctggcccttcacaattggcttggctgctcacctttgctctcatcctcaattattaatgactggagaaagctgctaagtatcttcagaatgttagatttcaacaagatggggggttcagggtccctggcaccctggatagggagccagcggcccctagagacctttgctgtgtgcagggggtatgtgctcacccccgtggcctcagcctcctcaatgtctgaatgaaggattgggctagcagacatcccaccccacagcacactttctaaccagcaggggaacttctagacaatagagacgctgggctccctccagaacactggacctgaacttctggggggagggctgggcacgggcatattttaaaagctccccagcagatgggccgtgcagtcaagtgggccaagagtggcaccagactttggggcttgtgaagtcaggagggagcaacagtgcccactcgagcttgcctggggctcaagcccaaggctgggctgctgccagcctgagcagacacccaggagcttccaggccagctggatgcacagggcacctttgtggaactcctaggaccctggggagacccacctcaggagcagagtctcaggtcccttccggctctgaggggctgttctgagctctaatgtcttatggtctgcccctcccatccttacttctcaggccctggaggcagaggcatagagccaggcaggacagaggtctcagtgggccacatgccagctgcccccacactgcctcagcctccaggcctccaaggggtcctggggagcccctgagaagatgctgagcctgcataaggctgggcgcccctctttctgacaccctcactggctccacggctcccccttcccatcccaggtttccatctgcccactgaacagggaggggaaactgaggcactcccctggcactgagggctccttctgtcatcctgcctgccctggatggtcctggctgcccctcagggcttggccctggcactgtgagcctcacagggctcagacccccacccccaacccagcactaaatggcactcggcaccagaatctcacttcagttggcaaaagcagcaattagcatgtaatgaggcttcttgctttatttttaggtaacctccaaggccctgcctgtgtaattcagcccgccattgctcggtggataattaaagcatgtcaccat

SEQ ID NO: 137539 - DNA, 4153 bp, Homo sapiens
  Payload ID: 6928
  Gene Symbol: GRM4
  Gene Name: glutamate receptor, metabotropic 4
  Uniprot ID: Q14833
  ENST ID: ENST00000538487
  CDS Start-End: 445-3183
ttttctgggtgtgtgttagggaggctatgttcctgaccctccccctctggggtgagaaggggtccccgccatgtcctcggggttggtaggaggagaggattggagctgttttctccttgatgccaagatacgccaagctaggagcattctgccctttccacagtcatccaccgagaacaggcctgcaggacgggacaaggatcagagccttcctgcaaccccggccactgcctgctgtctgtgggcctggactgtgcgggcaactgtgcttggcccgagtgacaaggaggtgggagagggtagcagcatgggctacgcggttggctgccctcagtccccctgctgctgaagctgccctgcccatgcccacccaggccgtggggccaggggcctgccagggctaggagtgggcctgccgttcatgggtctctagggatttccgagatgcctgggaagagaggcttgggctggtggtgggcccggctgcccctttgcctgctcctcagcctttacggcccctggatgccttcctccctgggaaagcccaaaggccaccctcacatgaattccatccgcatagatggggacatcacactgggaggcctgttcccggtgcatggccggggctcagagggcaagccctgtggagaacttaagaaggaaaagggcatccaccggctggaggccatgctgttcgccctggatcgcatcaacaacgacccggacctgctgcctaacatcacgctgggcgcccgcattctggacacctgctccagggacacccatgccctcgagcagtcgctgacctttgtgcaggcgctcatcgagaaggatggcacagaggtccgctgtggcagtggcggcccacccatcatcaccaagcctgaacgtgtggtgggtgtcatcggtgcttcagggagctcggtctccatcatggtggccaacatccttcgcctcttcaagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacgaaaacaaatctcgagtgtgttgccaagtgctgcgtcctcctggtggcctctgtgtgtgtccctgtggcccgcagcctgcccgcctgccccgcccatctgccgtgtgtcttgcccgcctgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggttttgca

SEQ ID NO: 137540 - DNA, 570 bp, Homo sapiens
  Payload ID: 6928
  Gene Symbol: GRM4
  Gene Name: glutamate receptor, metabotropic 4
  ENST ID: ENST00000609443
  CDS Start-End: 283-570
agagtgaccagatgctcagggcaggagtaggcagctggtctaaatccacagagcagaggaatagatctgattaatgagggagtcaagtcctgagggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggagggg

SEQ ID NO: 137541 - DNA, 2978 bp, Homo sapiens
  Payload ID: 6928
  Gene Symbol: GRM4
  Gene Name: glutamate receptor, metabotropic 4
  ENST ID: ENST00000609278
  CDS Start-End: 457-1002
gctttgctgtacttttctgggtgtgtgttagggaggctatgttcctgaccctccccctctggggtgagaaggggtccccgccatgtcctcggggttggtaggaggagaggattggagctgttttctccttgatgccaagatacgccaagctaggagcattctgccctttccacagtcatccaccgagaacaggcctgcaggacgggacaaggatcagagccttcctgcaaccccggccactgcctgctgtctgtgggcctggactgtgcgggcaactgtgcttggcccgagtgacaaggaggtgggagagggtagcagcatgggctacgcggttggctgccctcagtccccctgctgctgaagctgccctgcccatgcccacccaggccgtggggccaggggcctgccagggctaggagtgggcctgccgttcatgggtctctagggatttccgagatgcctgggaagagaggcttgggctggtggtgggcccggctgcccctttgcctgctcctcagcctttacggcccctggatgccttcctccctgggaaagcccaaaggccaccctcacatgaattccatccgcatagatggggacatcacactgggaggcctgttcccggtgcatggccggggctcagagggcaagccctgtggagaacttaagaaggaaaagggcatccaccggctggaggccatgctgttcgccctggatcgcatcaacaacgacccggacctgctgcctaacatcacgctgggcgcccgcattctggacacctgctccagggacacccatgccctcgagcagtcgctgacctttgtgcaggcgctcatcgagaaggatggcacagaggtccgctgtggcagtggcggcccacccatcatcaccaagcctgaacgtgtggtgggtgtcatcggtgcttcagggagctcggtctccatcatggtggccaacatccttcgcctcttcaagggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctag

SEQ ID NO: 137542 - DNA, 3176 bp, Homo sapiens
  Payload ID: 6928
  Gene Symbol: GRM4
  Gene Name: glutamate receptor, metabotropic 4
  Uniprot ID: Q14833
  ENST ID: ENST00000609222
  CDS Start-End: 194-2533
agagatgctggagctgtggacctgggcggtcctggtggaggagtgcctgacacatcccagtctttcaccgtggtgcctgtggacagatgaggagactgaggctcacaaaggaggtgacttgcccaaggtcacacagcgaggcagcttctcacctatgggagttggactttgagccctccttggaaaagggggcatggctgtgccccttggggctccttgctgggcctctgccctgcctgcctgggctcctcccggcctcccccacagatcactgttgacaaggttactgagtcagcatgtaaaacctgcaaaaataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagag

SEQ ID NO: 137543 - DNA, 4475 bp, Homo sapiens
  Payload ID: 6929
  Gene Symbol: GRM5
  Gene Name: glutamate receptor, metabotropic 5
  Uniprot ID: P41594
  ENST ID: ENST00000305432
  CDS Start-End: 151-3693
acaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggcaactatggagaaagtgggatggaagccttcaaagatatgtcagcgaaggaagggatttgcatcgcccactcttacaaaatctacagtaatgcaggggagcagagctttgataagctgctgaagaagctcacaagtcacttgcccaaggcccgggtggtggcctgcttctgtgagggcatgacggtgagaggtctgctgatggccatgaggcgcctgggtctagcgggagaatttctgcttctgggcagtgatggctgggctgacaggtatgatgtgacagatggatatcagcgagaagctgttggtggcatcacaatcaagctccaatctcccgatgtcaagtggtttgatgattattatctgaagctccggccagaaacaaaccaccgaaacccttggtttcaagaattttggcagcatcgttttcagtgccgactggaagggtttccacaggagaacagcaaatacaacaagacttgcaatagttctctgactctgaaaacacatcatgttcaggattccaaaatgggatttgtgatcaacgccatctattcgatggcctatgggctccacaacatgcagatgtccctctgcccaggctatgcaggactctgtgatgccatgaagccaattgatggacggaaacttttggagtccctgatgaaaaccaattttactggggtttctggagatacgatcctattcgatgagaatggagactctccaggaaggtatgaaataatgaatttcaaggaaatgggaaaagattactttgattatatcaacgttggaagttgggacaatggagaattaaaaatggatgatgatgaagtatggtccaagaaaagcaacatcatcagatctgtgtgcagtgaaccatgtgagaaaggccagatcaaggtgatccgaaagggagaagtcagctgttgttggacctgtacaccttgtaaggagaatgagtatgtctttgatgagtacacatgcaaggcatgccaactggggtcttggcccactgatgatctcacaggttgtgacttgatcccagtacagtatcttcgatggggtgaccctgaacccattgcagctgtggtgtttgcctgccttggcctcctggccaccctgtttgttactgtagtcttcatcatttaccgtgatacaccagtagtcaagtcctcaagcagggaactctgctacattatccttgctggcatctgcctgggctacttatgtaccttctgcctcattgcgaagcccaaacagatttactgctaccttcagagaattggcattggtctctccccagccatgagctactcagcccttgtaacaaagaccaaccgtattgcaaggatcctggctggcagcaagaagaagatctgtaccaaaaagcccagattcatgagtgcctgtgcccagctagtgattgctttcattctcatatgcatccagttgggcatcatcgttgccctctttataatggagcctcctgacataatgcatgactacccaagcattcgagaagtctacctgatctgtaacaccaccaacctaggagttgtcactccacttggatacaatggattgttgattttgagctgcaccttctatgcgttcaagaccagaaatgttccagctaacttcaacgaggccaagtatatcgccttcacaatgtacacgacctgcattatatggctagcttttgtgccaatctactttggcagcaactacaaaatcatcaccatgtgtttctcggtcagcctcagtgccacagtggccctaggctgcatgtttgtgccgaaggtgtacatcatcctggccaaaccagagagaaacgtgcgcagcgccttcaccacatctaccgtggtgcgcatgcatgtaggggatggcaagtcatcctccgcagccagcagatccagcagcctagtcaacctgtggaagagaaggggctcctctggggaaaccttaagttccaatggaaaatccgtcacgtgggcccagaatgagaagagcagccgggggcagcacctgtggcagcgcctgtccatccacatcaacaagaaagaaaaccccaaccaaacggccgtcatcaagcccttccccaagagcacggagagccgtggcctgggcgctggcgctggcgcaggcgggagcgctgggggcgtgggggccacgggcggtgcgggctgcgcaggcgccggcccaggcgggcccgagtccccagacgccggccccaaggcgctgtatgatgtggccgaggctgaggagcacttcccggcgcccgcgcggccgcgctcaccgtcgcccatcagcacgctgagccaccgcgcgggctcggccagccgcacggacgacgatgtgccgtcgctgcactcggagcctgtggcgcgcagcagctcctcgcagggctccctcatggagcagatcagcagtgtggtcacccgcttcacggccaacatcagcgagctcaactccatgatgctgtccaccgcggcccccagccccggcgtcggcgccccgctctgctcgtcctacctgatccccaaagagatccagttgcccacgaccatgacgacctttgccgaaatccagcctctgccggccatcgaagtcacgggaggcgcgcagcccgcggcaggggcgcaggcggctggggacgcggcccgggagagccccgcggccggtcccgaggctgcggccgccaagccagacctggaggagctggtggctctcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtgaatgtccctggaaagcacgccggcctgcgcgtgcggagcggagccccccgtgttcacacacacacaatggcaagcatagtcgcctggttacggcccagggggaagatgccaagggcaccccttaatggaaacacgagatcagtagtgctatctcatgacaaccgacgaagaaaccgacgacaaatcttttggcagattttcttctagtggccttagaaaacatgggcttttaagaaacacggctgatatctttgagggctgacaaggcgtctcttcaaacagttccataccaagtgctttgctctagggaagcagtgcgtgtgaaacagcgtaacggagggtgaagagcatagttaataagcaactgtaaaaagttttatttgtttactttaattcttttcccagaagagtctttgattcaccaaacatgaatgtacattttctaacaaactcaaaatctgggaccaaaacatcaacttttttctttcttttttctttctttttgttttttctttcctgtaaagaccttgaaaagcagtaacttgggtccagtatttacggaggcgttgtgaatgtgtcccatgcataacacactactggatagtgagtgctgcgctaatgtactacgtagggcttctaccagagattttcctctccaattgggttgtgaaatactcttccaaaagcctgcatcggggattccacctacttatttcagattcacctccattaaccaagaaaaccagtggaagatttcttgactatttcaccatgttgccaatc

SEQ ID NO: 137544 - DNA, 4571 bp, Homo sapiens
  Payload ID: 6929
  Gene Symbol: GRM5
  Gene Name: glutamate receptor, metabotropic 5
  Uniprot ID: P41594
  ENST ID: ENST00000305447
  CDS Start-End: 151-3789
acaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggcaactatggagaaagtgggatggaagccttcaaagatatgtcagcgaaggaagggatttgcatcgcccactcttacaaaatctacagtaatgcaggggagcagagctttgataagctgctgaagaagctcacaagtcacttgcccaaggcccgggtggtggcctgcttctgtgagggcatgacggtgagaggtctgctgatggccatgaggcgcctgggtctagcgggagaatttctgcttctgggcagtgatggctgggctgacaggtatgatgtgacagatggatatcagcgagaagctgttggtggcatcacaatcaagctccaatctcccgatgtcaagtggtttgatgattattatctgaagctccggccagaaacaaaccaccgaaacccttggtttcaagaattttggcagcatcgttttcagtgccgactggaagggtttccacaggagaacagcaaatacaacaagacttgcaatagttctctgactctgaaaacacatcatgttcaggattccaaaatgggatttgtgatcaacgccatctattcgatggcctatgggctccacaacatgcagatgtccctctgcccaggctatgcaggactctgtgatgccatgaagccaattgatggacggaaacttttggagtccctgatgaaaaccaattttactggggtttctggagatacgatcctattcgatgagaatggagactctccaggaaggtatgaaataatgaatttcaaggaaatgggaaaagattactttgattatatcaacgttggaagttgggacaatggagaattaaaaatggatgatgatgaagtatggtccaagaaaagcaacatcatcagatctgtgtgcagtgaaccatgtgagaaaggccagatcaaggtgatccgaaagggagaagtcagctgttgttggacctgtacaccttgtaaggagaatgagtatgtctttgatgagtacacatgcaaggcatgccaactggggtcttggcccactgatgatctcacaggttgtgacttgatcccagtacagtatcttcgatggggtgaccctgaacccattgcagctgtggtgtttgcctgccttggcctcctggccaccctgtttgttactgtagtcttcatcatttaccgtgatacaccagtagtcaagtcctcaagcagggaactctgctacattatccttgctggcatctgcctgggctacttatgtaccttctgcctcattgcgaagcccaaacagatttactgctaccttcagagaattggcattggtctctccccagccatgagctactcagcccttgtaacaaagaccaaccgtattgcaaggatcctggctggcagcaagaagaagatctgtaccaaaaagcccagattcatgagtgcctgtgcccagctagtgattgctttcattctcatatgcatccagttgggcatcatcgttgccctctttataatggagcctcctgacataatgcatgactacccaagcattcgagaagtctacctgatctgtaacaccaccaacctaggagttgtcactccacttggatacaatggattgttgattttgagctgcaccttctatgcgttcaagaccagaaatgttccagctaacttcaacgaggccaagtatatcgccttcacaatgtacacgacctgcattatatggctagcttttgtgccaatctactttggcagcaactacaaaatcatcaccatgtgtttctcggtcagcctcagtgccacagtggccctaggctgcatgtttgtgccgaaggtgtacatcatcctggccaaaccagagagaaacgtgcgcagcgccttcaccacatctaccgtggtgcgcatgcatgtaggggatggcaagtcatcctccgcagccagcagatccagcagcctagtcaacctgtggaagagaaggggctcctctggggaaaccttaaggtacaaagacaggagactggcccagcacaagtcggaaatagagtgtttcacccccaaagggagtatggggaatggtgggagagcaacaatgagcagttccaatggaaaatccgtcacgtgggcccagaatgagaagagcagccgggggcagcacctgtggcagcgcctgtccatccacatcaacaagaaagaaaaccccaaccaaacggccgtcatcaagcccttccccaagagcacggagagccgtggcctgggcgctggcgctggcgcaggcgggagcgctgggggcgtgggggccacgggcggtgcgggctgcgcaggcgccggcccaggcgggcccgagtccccagacgccggccccaaggcgctgtatgatgtggccgaggctgaggagcacttcccggcgcccgcgcggccgcgctcaccgtcgcccatcagcacgctgagccaccgcgcgggctcggccagccgcacggacgacgatgtgccgtcgctgcactcggagcctgtggcgcgcagcagctcctcgcagggctccctcatggagcagatcagcagtgtggtcacccgcttcacggccaacatcagcgagctcaactccatgatgctgtccaccgcggcccccagccccggcgtcggcgccccgctctgctcgtcctacctgatccccaaagagatccagttgcccacgaccatgacgacctttgccgaaatccagcctctgccggccatcgaagtcacgggaggcgcgcagcccgcggcaggggcgcaggcggctggggacgcggcccgggagagccccgcggccggtcccgaggctgcggccgccaagccagacctggaggagctggtggctctcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtgaatgtccctggaaagcacgccggcctgcgcgtgcggagcggagccccccgtgttcacacacacacaatggcaagcatagtcgcctggttacggcccagggggaagatgccaagggcaccccttaatggaaacacgagatcagtagtgctatctcatgacaaccgacgaagaaaccgacgacaaatcttttggcagattttcttctagtggccttagaaaacatgggcttttaagaaacacggctgatatctttgagggctgacaaggcgtctcttcaaacagttccataccaagtgctttgctctagggaagcagtgcgtgtgaaacagcgtaacggagggtgaagagcatagttaataagcaactgtaaaaagttttatttgtttactttaattcttttcccagaagagtctttgattcaccaaacatgaatgtacattttctaacaaactcaaaatctgggaccaaaacatcaacttttttctttcttttttctttctttttgttttttctttcctgtaaagaccttgaaaagcagtaacttgggtccagtatttacggaggcgttgtgaatgtgtcccatgcataacacactactggatagtgagtgctgcgctaatgtactacgtagggcttctaccagagattttcctctccaattgggttgtgaaatactcttccaaaagcctgcatcggggattccacctacttatttcagattcacctccattaaccaagaaaaccagtggaagatttcttgactatttcaccatgttgccaatc

SEQ ID NO: 137545 - DNA, 1268 bp, Homo sapiens
  Payload ID: 6929
  Gene Symbol: GRM5
  Gene Name: glutamate receptor, metabotropic 5
  ENST ID: ENST00000393294
  CDS Start-End: 371-1267
cgcgagagagcgagcgccaccgccgcgggccccgcagccgttctgcctgctgtcaccgctgcctccatcgccgacactagcgctccagctgcagccaaggccgctacgagagcgcaggaagccctcgaggagcggctgcctgggggcgcaaggctcagggcgcgcacctggtttagaagatcatgaccacatggatcatctaactaaatggtacatggggacaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggtagagggacaaagaaggaagagatgcgtaagagggatcagacattgatgttatcttttatgaggtgtgtgttcttgagatttgaagaaattagatggaatgattctttagtatatgatgccctggaaaatgaaaacatccaagtgctgtctctctgtttccccagcagtgctgtaattcaaataaatacctttctttctcctatagctttaataaaccgtttgaatgttacataaa

SEQ ID NO: 137546 - DNA, 450 bp, Homo sapiens
  Payload ID: 6929
  Gene Symbol: GRM5
  Gene Name: glutamate receptor, metabotropic 5
  ENST ID: ENST00000449371
  CDS Start-End: 1-263
ctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggtagagggacaaagaaggaagagatgcgtaagagggatcagacattgatgttatcttttatgaggttcaagctattctcatgcctcagcctccagaggagctaggattacaggcatgtaccacacccaggaagttatacagatacacgttcctctgaacttcgccaatacttacagtattgtacaatacttatttgtgacttctcatcaacaccccaactggttagatgctgttatttttactggttgtatattaagacaataaaaaatttcgtacttgggtagcaaagaa

SEQ ID NO: 137547 - DNA, 7927 bp, Homo sapiens
  Payload ID: 6929
  Gene Symbol: GRM5
  Gene Name: glutamate receptor, metabotropic 5
  Uniprot ID: P41594
  ENST ID: ENST00000455756
  CDS Start-End: 369-3911
agctcggctgttctgcgcacgctgagcggagggaatgagcttgagatcatcttgggggggaagccggggactggagaggccggctctgccctgctgatccccgtggcccaacttttcggggggctagctagaccgagtctcactgctcgcagcgcagccaacaggggggtttagaagatcatgaccacatggatcatctaactaaatggtacatggggacaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggcaactatggagaaagtgggatggaagccttcaaagatatgtcagcgaaggaagggatttgcatcgcccactcttacaaaatctacagtaatgcaggggagcagagctttgataagctgctgaagaagctcacaagtcacttgcccaaggcccgggtggtggcctgcttctgtgagggcatgacggtgagaggtctgctgatggccatgaggcgcctgggtctagcgggagaatttctgcttctgggcagtgatggctgggctgacaggtatgatgtgacagatggatatcagcgagaagctgttggtggcatcacaatcaagctccaatctcccgatgtcaagtggtttgatgattattatctgaagctccggccagaaacaaaccaccgaaacccttggtttcaagaattttggcagcatcgttttcagtgccgactggaagggtttccacaggagaacagcaaatacaacaagacttgcaatagttctctgactctgaaaacacatcatgttcaggattccaaaatgggatttgtgatcaacgccatctattcgatggcctatgggctccacaacatgcagatgtccctctgcccaggctatgcaggactctgtgatgccatgaagccaattgatggacggaaacttttggagtccctgatgaaaaccaattttactggggtttctggagatacgatcctattcgatgagaatggagactctccaggaaggtatgaaataatgaatttcaaggaaatgggaaaagattactttgattatatcaacgttggaagttgggacaatggagaattaaaaatggatgatgatgaagtatggtccaagaaaagcaacatcatcagatctgtgtgcagtgaaccatgtgagaaaggccagatcaaggtgatccgaaagggagaagtcagctgttgttggacctgtacaccttgtaaggagaatgagtatgtctttgatgagtacacatgcaaggcatgccaactggggtcttggcccactgatgatctcacaggttgtgacttgatcccagtacagtatcttcgatggggtgaccctgaacccattgcagctgtggtgtttgcctgccttggcctcctggccaccctgtttgttactgtagtcttcatcatttaccgtgatacaccagtagtcaagtcctcaagcagggaactctgctacattatccttgctggcatctgcctgggctacttatgtaccttctgcctcattgcgaagcccaaacagatttactgctaccttcagagaattggcattggtctctccccagccatgagctactcagcccttgtaacaaagaccaaccgtattgcaaggatcctggctggcagcaagaagaagatctgtaccaaaaagcccagattcatgagtgcctgtgcccagctagtgattgctttcattctcatatgcatccagttgggcatcatcgttgccctctttataatggagcctcctgacataatgcatgactacccaagcattcgagaagtctacctgatctgtaacaccaccaacctaggagttgtcactccacttggatacaatggattgttgattttgagctgcaccttctatgcgttcaagaccagaaatgttccagctaacttcaacgaggccaagtatatcgccttcacaatgtacacgacctgcattatatggctagcttttgtgccaatctactttggcagcaactacaaaatcatcaccatgtgtttctcggtcagcctcagtgccacagtggccctaggctgcatgtttgtgccgaaggtgtacatcatcctggccaaaccagagagaaacgtgcgcagcgccttcaccacatctaccgtggtgcgcatgcatgtaggggatggcaagtcatcctccgcagccagcagatccagcagcctagtcaacctgtggaagagaaggggctcctctggggaaaccttaagttccaatggaaaatccgtcacgtgggcccagaatgagaagagcagccgggggcagcacctgtggcagcgcctgtccatccacatcaacaagaaagaaaaccccaaccaaacggccgtcatcaagcccttccccaagagcacggagagccgtggcctgggcgctggcgctggcgcaggcgggagcgctgggggcgtgggggccacgggcggtgcgggctgcgcaggcgccggcccaggcgggcccgagtccccagacgccggccccaaggcgctgtatgatgtggccgaggctgaggagcacttcccggcgcccgcgcggccgcgctcaccgtcgcccatcagcacgctgagccaccgcgcgggctcggccagccgcacggacgacgatgtgccgtcgctgcactcggagcctgtggcgcgcagcagctcctcgcagggctccctcatggagcagatcagcagtgtggtcacccgcttcacggccaacatcagcgagctcaactccatgatgctgtccaccgcggcccccagccccggcgtcggcgccccgctctgctcgtcctacctgatccccaaagagatccagttgcccacgaccatgacgacctttgccgaaatccagcctctgccggccatcgaagtcacgggaggcgcgcagcccgcggcaggggcgcaggcggctggggacgcggcccgggagagccccgcggccggtcccgaggctgcggccgccaagccagacctggaggagctggtggctctcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtgaatgtccctggaaagcacgccggcctgcgcgtgcggagcggagccccccgtgttcacacacacacaatggcaagcatagtcgcctggttacggcccagggggaagatgccaagggcaccccttaatggaaacacgagatcagtagtgctatctcatgacaaccgacgaagaaaccgacgacaaatcttttggcagattttcttctagtggccttagaaaacatgggcttttaagaaacacggctgatatctttgagggctgacaaggcgtctcttcaaacagttccataccaagtgctttgctctagggaagcagtgcgtgtgaaacagcgtaacggagggtgaagagcatagttaataagcaactgtaaaaagttttatttgtttactttaattcttttcccagaagagtctttgattcaccaaacatgaatgtacattttctaacaaactcaaaatctgggaccaaaacatcaacttttttctttcttttttctttctttttgttttttctttcctgtaaagaccttgaaaagcagtaacttgggtccagtatttacggaggcgttgtgaatgtgtcccatgcataacacactactggatagtgagtgctgcgctaatgtactacgtagggcttctaccagagattttcctctccaattgggttgtgaaatactcttccaaaagcctgcatcggggattccacctacttatttcagattcacctccattaaccaagaaaaccagtggaagatttcttgactatttcaccatgttgccaatcaatactggagtagcaaaaaaaatattttctggaatactgttttgtaattccctcactggggtgcattgtagctggaaattctctttataaaaatcattcttgagctccagcctggctatctctttcaagaaacatggccactctttaggaatgctgttgcgtttgcattgccaactaaaatattaaaatatgcattggggcttcttcattcctttattttgagaacctgatgcacaaagagctcctttgttcttttcgagtcccaccactggaagagtggtccatagaccccatgaagacattgtcatgatttgagagactgttgttgaaaggattaacacaatcttaatacactgaaaattttaactgtgtcaagtcagcttagtggagatttagctatgccagtgagcagtgattttaactattcttggctgcttaaacagggcagctatgaactatgacaaatgtagatttttcaaagcaatacaaaatactaaaaaagaggaaccttaatgaatattaaccacacagtctttcttagccattccaaaaagaggcaaagcaattcttattttcttttttaaaataatgattaatatgattttgtgcacttcatactgtcactttttaaaactacagaaaagagatttagagtataacagaaacaagtgtgctttgatagtctcaaataggtagaattcatagttcaagacctgaatccactgtcatctctttcttcctcccattgcagctatcctcaggtaccaaatgttttgatttttaaataaggatagtaataaatggaggaggtgtcctataaatttaaagttcagttgacccagccttatacttaagatagccttatgaaaaatatgtgctgtgaggcagaagtatattttggcagagagaataataaataaaactttttcttttagctcaatatccttactttggtaagtatttttttttatttcacatctacttaacagaaaataaactgagaaatagaagtcagtccattggcataatttatcattcttcactttaaaaaattctaataaatattctgcttgagttttcttttctgctatttgttcttacttgcaactttaagtcaaacctcccaatacaaaacattaaaagctaacattaatgtactaaagtattaatttaaaagaaatcgaacctcccatgctagatttgaaaataacatcatcacagcaccctgatcccaaatattacaccgaggcttttaaaatgtaagtgaaatctagctaagtttcatggtttcattaaaagcaaatgtctgcctctatctgaaaaacaaatggaaatcttttgaggtgttaataccctttggatcctcatcaaaaggatggcattcacctgaggattcctatcttgacttcttaggtattaaaaacctttcttgatatgctctacattttaaaatttgttttataaaatccttatgttgattttcattttattctcaagtacaatacgtttcactctagaccagttgaagaacatgtttaaactttgttcatggtcaaattcattttctatttttttagtaacatatctcttaaaaagcacactaccttataaaaaacttcatcagaaattaaatttaatgcaagtaaattgccatctgatacttccacatgctatcataatcaactgtaataataaaaatgatttatccaattagaaaaggacaagatatatttttctctgtatttctataacttttgccactccattgaatacattgtatgttggacataagattattagtaatgcattcttgagatcttttattttggaatgatgctaactctgtctctttgccaattctaataccaggttccaagtaataactctacagtacaaagagaactgaatattcattctagggctataggatatgaacttcacaattcatttgggtacattctcattgaatttccttcaaaacaatctgttcctggtgcccagtgataattcagtcgggaccagcatgactaaaaggaaggggatatgctaaggctcagcaaagtgaccctaaatgagagatatgtcccaggatggaaagaagaagacgtggtttaaccaagttatactgactaatctaagcagtccactcatccttccattttgggaaaggagtgggggcagcctaagaagaacatatctggattgggaagaaccgtctttctgggctagggatggggaacagaaagggagtatggaaagaaaaattataagagatttgactgaagcaaggaaaaaaagcaaatccccaaacgtgctaatccttgaaagtaactatctttcccaaactactgctgttaccagcaagtgatcaggaagactaggagctatttctgactgtaaatgaattgtataatagctctgctgcagttctgtgacttccaagccaggaattaaatgctctttttaagaataacaaaaaacaaaagcatttcctatgctagtctcccagtaaaatgtacatgttttggagacttcaaaggtattatgtgagttcacatttagcaacagcttattaataaccctcaagctgtcagaatctctatagttaccatttacaattttatactgtgaaaaaatacagatcagtgaaagcataaagacaagtcagaattcactttgaagagggtctgaggcctgggagagtctctactgtctattgaagaatgaggcatgtataaaatagttggttgaatttcactgatcttcccaatgtgaacaaatatactatgtatattgtgtgtatttctagaaatcaatggcagctgctgatggtgttgtaattagaaatctatatagattatagatgttttagaaagatggtgccaatcctaaaagatttgtgtgggctaaaagtgcttgtacttacttttttctgcacttataactgatttggttttaaaattgtgtgcgtgtatctgttctttctctgttgtggcagcttgtactattaaaataatagagaatgttaaattattttgatgtgaactgcaaatgattttttttcataaagtttaacatttttatcagcattgttttgctttgtacttgtataaatatgttttattttagcacttcaaaatatacttgcctgtttctcagttgtctaaatcatgttgtacttggtgtttgtgaagccagttacttttcaaaaaaattaaaaaacctataatatga

SEQ ID NO: 137548 - DNA, 6143 bp, Homo sapiens
  Payload ID: 6930
  Gene Symbol: GRM6
  Gene Name: glutamate receptor, metabotropic 6
  Uniprot ID: O15303
  ENST ID: ENST00000231188
  CDS Start-End: 180-2813
cggaggcccgggcaggccggctgagctaactccccagagccgaagtggaaggcgcgccccgagcgccttctccccaggaccccggtgtccctccccgcgccccgagcccgcgctctccttcccccgccctcagagcgctccccgcccctctgtctccccgcagcccgctagacgagccgatggcgcggccccggagagcccgggagccgctgctcgtggcgctgctgccgctggcgtggctggcgcaggcgggcctggcgcgcgcggcgggctctgtgcgcctggcgggcggcctgacgctgggcggcctgttcccggtgcacgcgcggggcgcggcgggccgggcgtgcgggcagctgaagaaggagcagggcgtgcaccggctggaggccatgctgtacgcgctggaccgcgtcaacgccgaccccgagctgctgcccggcgtgcgcctgggcgcgcggctgctggacacctgctcgcgggacacctacgcgctggagcaggcgctgagcttcgtgcaggcgctgatccgcggccgcggcgacggcgacgaggtgggcgtgcgctgcccgggaggcgtccctccgctgcgccccgcgccccccgagcgcgtcgtggccgtcgtgggcgcctcggccagctccgtctccatcatggtcgccaacgtgctgcgcctgtttgcgataccccagatcagctatgcctccacagccccggagctcagcgactccacacgctatgacttcttctcccgggtggtgccacccgactcctaccaggcgcaggccatggtggacatcgtgagggcactgggatggaactatgtgtccacgctggcctccgagggcaactatggcgaaagtggggttgaggccttcgttcagatctcccgagaggctgggggggtctgtattgcccagtctatcaagattcccagggaaccaaagccaggagagttcagcaaggtgatcaggagactcatggagacgcccaacgcccggggcatcatcatctttgccaatgaggatgacatcaggcgggtcctggaggcagctcgccaggccaacctgaccggccacttcctgtgggtcggctcagacagctggggagccaagacctcacccatcttgagcctggaggacgtggccgttggggccatcaccatcctgcccaaaagggcctccatcgacggatttgaccagtacttcatgactcgatccctggagaacaaccgcaggaacatctggttcgccgagttctgggaagagaattttaactgcaaactgaccagctcaggtacccagtcagacgattccacccgcaaatgcacaggcgaggaacgcatcggccgggactccacctacgagcaggagggcaaggtgcagtttgtgattgatgcggtgtacgccattgcccacgccctccacagcatgcaccaggcgctctgccctgggcacacaggcctgtgcccggcgatggaacccactgatgggcggatgcttctgcagtacattcgagctgtccgcttcaatggcagcgcaggaacccctgtgatgttcaacgagaacggagatgcgcccgggcggtacgacatcttccagtaccaggcgaccaatggcagtgccagcagtggcgggtaccaggcagtgggccagtgggcagagaccctcagactggatgtggaggccctgcagtggtctggcgacccccacgaggtgccctcgtctctgtgcagcctgccctgcgggccgggggagcggaagaagatggtgaagggcgtcccctgctgttggcactgcgaggcctgtgacgggtaccgcttccaggtggacgagttcacatgcgaggcctgtcctggggacatgaggcccacgcccaaccacacgggctgccgccccacacctgtggtgcgcctgagctggtcctccccctgggcagccccgccgctcctcctggccgtgctgggcatcgtggccactaccacggtggtggccaccttcgtgcggtacaacaacacgcccatcgtccgggcctcgggccgagagctcagctacgtcctcctcaccggcatcttcctcatctacgccatcaccttcctcatggtggctgagcctggggccgcggtctgtgccgcccgcaggctcttcctgggcctgggcacgaccctcagctactctgccctgctcaccaagaccaaccgtatctaccgcatctttgagcagggcaagcgctcggtcacaccccctcccttcatcagccccacctcacagctggtcatcaccttcagcctcacctccctgcaggtggtggggatgatagcatggctgggggcccggcccccacacagcgtgattgactatgaggaacagcggacggtggaccccgagcaggccagaggggtgctcaagtgcgacatgtcggatctgtctctcatcggctgcctgggctacagcctcctgctcatggtcacgtgcacagtgtacgccatcaaggcccgtggcgtgcccgagaccttcaacgaggccaagcccatcggcttcaccatgtacaccacctgcatcatctggctggcattcgtgcccatcttctttggcactgcccagtcagctgaaaagatctacatccagacaaccacgctaaccgtgtccttgagcctgagtgcctcggtgtccctcggcatgctctacgtacccaaaacctacgtcatcctcttccatccagagcagaatgtgcagaagcgaaagcggagcctcaaggccacctccacggtggcagccccacccaagggcgaggatgcagaggcccacaagtagcagggcaggtgggaacgggactgcttgctgcctctcctttcttcctcttgcctcgaggtggaagctgtatagagcccgggtccacggtgaacagtcagtggcagggagtttgccaagaccatgctccgcgtcggtggggctggccttgagaaggaactggacccagctctaccccgattccagcatgtgagcttcatgcttcctcaccacagaccagactcgcttcccatggtgggaaacagccaccgagaaggttctagctctagaaagggactaaacttattctctcatccgaagtccaaagaggatgatgaagccctgggctttgcctggtttgcgggagatttcctcccctcagtcaacccccataacctggggattgggcagtgtggaagaacgtgtagaccccagaatgaaacatggggttggagtggaggaggagctgtctcagcaagaggagacctggggctgtgcatctggatggaggcactcaggcctgggtaggattcctctggcacggagggagagaccctgggtgagacccctgtgagcatgggaagggcctgcagtgggcgcgggagtgagctgaggaactggggtgcgcccccatgagattcccaatgccatgggctttcccccatccccccgggattgggcaaggtcagacttagagtacagctgttttcctcccctctgtgtactcccttaaatcaccccaaccttggccaggcatggtggctcacacctgtaatcccagcactttgggaggccgaggcaggtggatcacctgaggtccggagttcgagaccagcctggccaatgtggtgaaaccctgtctctactaaaaatacaaaaattagccaggtgtgatggtgggtgcctgtaatcccagttacttgggaggctgaggcaggagaatcgcttgaacctgggaggtggaggttgcagtgagctgtgattgtgccactgtactccagcctgggtgacagagcgagactctgtctcaaaaaaacaaaacaaaaaaacaccaaaaaaacccccaaacctgaagaaattcagatacacgtgtgtaatgttagtgatgtgagaacaaggagcaggggtgcatttgtgttgtgttcgggttggggatgggtttaggagctccaggttgggagcagtgacagagagtcatggccgtggtgagggtgaatcccaagtggatggctcaggacgggtatggaaacccttcattcctcataggtactgggaagtccatttgcaagctgagcgccaggcctggggaggaagaggcttgggctgcagatgcacgcacatttgtttttcactgatagtttttacaaaaagcttggtttaagttatggagttttatgtccctgggagtagaatttacatttgttaaattgaccactgtttaagatcagtatacattctctagtctgtgatgtctggagctagttttgagggtgaaccacactttatccaacatacaaactttcccatgcagcttctctggtgcgcagttggttttgaccgtgggactaggtgcttctgcaggttttaagtaattaacttaaaagcttctcctctgagaaacatttctgttgcgctactgactctccttctccacatttgttgtgttcctagggcttctctatagtgcacattaggacgtttcatttgttgctgaatgctttccagaattatttattccatagggtttctctcctgtgcagctctctcatgggtaatggggcgtgttttcttgccaaaggcggttccaccctcgtgattgtatagggctcttctcctgtatgaactctgagatcagtgagctctgatctccaagggaaagttttcctgcatttgctgttttctcatgtctctcccagtgtgaattctttggtgtgcagtgcgctctggcttctagctgaaaacttttccacagttttacattcatgtggttttctccactgtgaactctgtgattcagaatcagaagcagttcttagtagaggcatttctacactgattgcactgaggatttctccccagtgtgaagtttctggcatagagtcctggcttcccgcagacgactttcacactctgccatgttcatgcctgtgggcctctctggcaggaactctgatgcaccgcgaggcccatgtactcctgtggctttctcacattcggtctacttgcagggtatctccacagcatgcaccattctgggtacagggggacatcctctgttactgaagatgttgtcatatttagtaccttcacaaggtttctctccttccagaattttctgatgtacacaaataactgacttccacaagagggcttttccacactcggtgtgtgcatacagtttctgcctgtgatcatttctttatgttattattttattttttcgagatagggtcttgctcaatttcttaggctggagtgcagtggcacgatcatagctcactgaagtttcgacctgggctcaagcaatcctcccgcttcagcctcctgagtagctggtgcgcacgaccatacccagctaatgttttattttttgtagagacgaggtctcactatgttgcccaggctggtctcgaacttctgagctcgagcgatcctcctgcctccacctcccaaagtgttcggattacaaacgtgagccatcgcacctagcctctttgatcatttctgtggtgttcagtggaggttgacagctccctaaagattttcctgtttttttgcatgcatgggtttgaattctttgaggtccaatttatttggacccctgaataaagttttgtgggttttcttctatgtgtggaatttataaggcattcttccagtgtggtttctcttatgtcgagtgagagctgacctgcaccgaaggttttgtcccatttgttgcccttgaattatttgtatgaattatatgttccagtgaaaatggagttctgggttggaggcttattccatgtttacacaattaaaattgcagtgttcctctctgggatgagagctctaaagcagagtaagattacgttctgatgtaagctttaaccacctatttataaggtctcacctgtggtccactgtgttgagacttctacagaagagcttctgtatagtaaccattttcttaggctgtctcacttgtgtgaatcttctgacacatttattatagctttgtcccatttcttatcctttttgctctttagaaatttccctttaatttattacattcattgcttactgtaaagagtccaggtaactgactttattcagttacttcctgttcaataaatttaacttttcccaaaa

SEQ ID NO: 137549 - DNA, 2673 bp, Homo sapiens
  Payload ID: 6930
  Gene Symbol: GRM6
  Gene Name: glutamate receptor, metabotropic 6
  Uniprot ID: O15303
  ENST ID: ENST00000517717
  CDS Start-End: 40-2673
tgaaccgacagcggctggcgcagcccgctagacgagccgatggcgcggccccggagagcccgggagccgctgctcgtggcgctgctgccgctggcgtggctggcgcaggcgggcctggcgcgcgcggcgggctctgtgcgcctggcgggcggcctgacgctgggcggcctgttcccggtgcacgcgcggggcgcggcgggccgggcgtgcgggcagctgaagaaggagcagggcgtgcaccggctggaggccatgctgtacgcgctggaccgcgtcaacgccgaccccgagctgctgcccggcgtgcgcctgggcgcgcggctgctggacacctgctcgcgggacacctacgcgctggagcaggcgctgagcttcgtgcaggcgctgatccgcggccgcggcgacggcgacgaggtgggcgtgcgctgcccgggaggcgtccctccgctgcgccccgcgccccccgagcgcgtcgtggccgtcgtgggcgcctcggccagctccgtctccatcatggtcgccaacgtgctgcgcctgtttgcgataccccagatcagctatgcctccacagccccggagctcagcgactccacacgctatgacttcttctcccgggtggtgccacccgactcctaccaggcgcaggccatggtggacatcgtgagggcactgggatggaactatgtgtccacgctggcctccgagggcaactatggcgaaagtggggttgaggccttcgttcagatctcccgagaggctgggggggtctgtattgcccagtctatcaagattcccagggaaccaaagccaggagagttcagcaaggtgatcaggagactcatggagacgcccaacgcccggggcatcatcatctttgccaatgaggatgacatcaggcgggtcctggaggcagctcgccaggccaacctgaccggccacttcctgtgggtcggctcagacagctggggagccaagacctcacccatcttgagcctggaggacgtggccgttggggccatcaccatcctgcccaaaagggcctccatcgacggatttgaccagtacttcatgactcgatccctggagaacaaccgcaggaacatctggttcgccgagttctgggaagagaattttaactgcaaactgaccagctcaggtacccagtcagacgattccacccgcaaatgcacaggcgaggaacgcatcggccgggactccacctacgagcaggagggcaaggtgcagtttgtgattgatgcggtgtacgccattgcccacgccctccacagcatgcaccaggcgctctgccctgggcacacaggcctgtgcccggcgatggaacccactgatgggcggatgcttctgcagtacattcgagctgtccgcttcaatggcagcgcaggaacccctgtgatgttcaacgagaacggagatgcgcccgggcggtacgacatcttccagtaccaggcgaccaatggcagtgccagcagtggcgggtaccaggcagtgggccagtgggcagagaccctcagactggatgtggaggccctgcagtggtctggcgacccccacgaggtgccctcgtctctgtgcagcctgccctgcgggccgggggagcggaagaagatggtgaagggcgtcccctgctgttggcactgcgaggcctgtgacgggtaccgcttccaggtggacgagttcacatgcgaggcctgtcctggggacatgaggcccacgcccaaccacacgggctgccgccccacacctgtggtgcgcctgagctggtcctccccctgggcagccccgccgctcctcctggccgtgctgggcatcgtggccactaccacggtggtggccaccttcgtgcggtacaacaacacgcccatcgtccgggcctcgggccgagagctcagctacgtcctcctcaccggcatcttcctcatctacgccatcaccttcctcatggtggctgagcctggggccgcggtctgtgccgcccgcaggctcttcctgggcctgggcacgaccctcagctactctgccctgctcaccaagaccaaccgtatctaccgcatctttgagcagggcaagcgctcggtcacaccccctcccttcatcagccccacctcacagctggtcatcaccttcagcctcacctccctgcaggtggtggggatgatagcatggctgggggcccggcccccacacagcgtgattgactatgaggaacagcggacggtggaccccgagcaggccagaggggtgctcaagtgcgacatgtcggatctgtctctcatcggctgcctgggctacagcctcctgctcatggtcacgtgcacagtgtacgccatcaaggcccgtggcgtgcccgagaccttcaacgaggccaagcccatcggcttcaccatgtacaccacctgcatcatctggctggcattcgtgcccatcttctttggcactgcccagtcagctgaaaagatctacatccagacaaccacgctaaccgtgtccttgagcctgagtgcctcggtgtccctcggcatgctctacgtacccaaaacctacgtcatcctcttccatccagagcagaatgtgcagaagcgaaagcggagcctcaaggccacctccacggtggcagccccacccaagggcgaggatgcagaggcccacaagtag

SEQ ID NO: 137550 - DNA, 4127 bp, Homo sapiens
  Payload ID: 6931
  Gene Symbol: GRM7
  Gene Name: glutamate receptor, metabotropic 7
  Uniprot ID: Q14831
  ENST ID: ENST00000357716
  CDS Start-End: 275-3022
agtgctgggctgttggagagagcgagcagcaagccggtgagcgcgagcgcggcgcgccggccggctaacccgagagcgcgaggcgccccaggctggcaggcgccgcgggacccctcaccctctctggtcgcccctccccggattcccccaccctccgtgcctgcaggagcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacagccctgctgcaaaaaagaagtatgtcagttataataacctggttatctaacctgttccattccatggaaccatggaggaggaagaccctcagttattttgtcacccaacctggcataggactctttggtcctacccgcttcccatcaccggaggagcttccccggccgggagaccagtgttagaggatccaagcgacctaaacagctgctttatgaaatatccttactttatctgggcttaataagtcactgacatcagcactgccaactcggctgcaattgtggaccttccctaccaaagggagtgttgaaactcaagtcccgccctggctctttagaatggaccactgagagccacaggaccgttttggggctgacctgtcttattacgtatgtacttctaggttgcaaggttttgaaattttctgtacagtttgtgaggacctttgcactttgccatctgatgtcgtacctcggttcactgtttgttttcgaatgccttgttttcatagagccctattctctcagacggtggaatatttggaaaaattttaaaacaattaaaattttaaagcaatcttggcagactaaaacaagtacatctgtacatgactgtataattacgattatagtaccactgcacatcatgtttttttttttaagacaaaaaagatgtttaaagaccaaaaactgtgctgagaaagtatgccccacctatctttggtatatgataggttacataaaaggaaggtattggctgaactgaatagaggtcttgatctttggaatgcatgccagtaatgtattttacagtacatgtttattatgttcaatatttgtatttgtgttctcttttgttatttttaattagggtatatgaatattttgcaataattttaataattattaagctgtttgaaggaaagaatatggatttttcatgtcttgaggttttgttcatgccccctttgactgatcagtgtgataaggactttaggaaaaaaagcatgtatgttttttactgtttgtaataagtactttcgttaatcttgctgcttatgtgccaatttagtggaaaaaaacaacccttgctgaaaaattccctctttccattctctttcaattctgtgatattgtccaagaatgtatcaataa

SEQ ID NO: 137551 - DNA, 3020 bp, Homo sapiens
  Payload ID: 6931
  Gene Symbol: GRM7
  Gene Name: glutamate receptor, metabotropic 7
  Uniprot ID: Q14831
  ENST ID: ENST00000389335
  CDS Start-End: 150-2885
ggtcgcccctccccggattcccccaccctccgtgcctgcaggagcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacataacctctgaggacctcagcttgcacaaagaggattgagataacatttccaaagcttgttcttcttgagctgacccaacacttaggaaaacatgacatggatcagcaactccattttctgtgagaagtgcaactgctactgaccatctgcactggcatctagtcaagcgattg

SEQ ID NO: 137552 - DNA, 2901 bp, Homo sapiens
  Payload ID: 6931
  Gene Symbol: GRM7
  Gene Name: glutamate receptor, metabotropic 7
  Uniprot ID: Q14831
  ENST ID: ENST00000389336
  CDS Start-End: 150-2870
ggtcgcccctccccggattcccccaccctccgtgcctgcaggagcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacagtgagaagtgcaactgctactgaccatctgcactggcatctagtcaagcgattg

SEQ ID NO: 137553 - DNA, 2034 bp, Homo sapiens
  Payload ID: 6931
  Gene Symbol: GRM7
  Gene Name: glutamate receptor, metabotropic 7
  ENST ID: ENST00000402647
  CDS Start-End: 1-2034
ggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacaactgtataccaccagtaagaaagagtgtacaaaagtctgttacttggtacactatcccaccaacagtatag

SEQ ID NO: 137554 - DNA, 595 bp, Homo sapiens
  Payload ID: 6931
  Gene Symbol: GRM7
  Gene Name: glutamate receptor, metabotropic 7
  ENST ID: ENST00000448328
  CDS Start-End: 230-595
agatggaaatgcagaaatcacccgtattcggccatcttggctcctcccccgaaacatccatgtctgattagcatgaaggttatgaggagaacgtgatcacagccaaggtagtcttctcaaaaagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgca

SEQ ID NO: 137555 - DNA, 683 bp, Homo sapiens
  Payload ID: 6931
  Gene Symbol: GRM7
  Gene Name: glutamate receptor, metabotropic 7
  ENST ID: ENST00000445087
  CDS Start-End: 129-683
aaaatgaagatggtaaccaggcaacatggttcttctatagttattaaaaataaaacgtgaagcttctacaatgcacaataattttctgacaagtttgtctggctttctttctgtcattgcctggagaaatggggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaag

SEQ ID NO: 137556 - DNA, 579 bp, Homo sapiens
  Payload ID: 6931
  Gene Symbol: GRM7
  Gene Name: glutamate receptor, metabotropic 7
  ENST ID: ENST00000443259
  CDS Start-End: 53-259
acggtgcgcgcacccactgacctgcgcccactgtctggcgctccctagtgagatgaacccggtacctcagatggaaatgcagaaatcacccgtattcggccatcttggctcctcccccgaagtgttatggaatacaaggtattacacagaagcagcaatttggaaagaccatcttgagagattcttcataaaaacagaaccccagtctataaggaaacatccatgtctgattagcatgaaggttatgaggagaacgtgatcacagccaaggtagtcttctcaaaaaggtagaactagatgacattgcaggcagtgagatgttatcatgtttgacccctggaactgtccaaaaatggaagaagctgcctcatcagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagattt

SEQ ID NO: 137557 - DNA, 826 bp, Homo sapiens
  Payload ID: 6931
  Gene Symbol: GRM7
  Gene Name: glutamate receptor, metabotropic 7
  ENST ID: ENST00000435689
  CDS Start-End: 239-352
actatctccctgacgcagaccccaagccaaatcctcggcttggaggacgattcccggagcgaggcatgaaggcgcccgttgggaggcagaggggtgcgtgaagcggggccccgtggtcctcctgctccggtgccggagggagacggagaaaaaatgggaggaaggcggatccggggccgctgagcggtgggttctgccgcagtgttctctcgcctcctgctccagcagcctctgccccatggctcctgagctgcactggggagatgcccttctatcctgtctcagtttcccaatcctaaacgtccttcaaaaatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaag

SEQ ID NO: 137558 - DNA, 3088 bp, Homo sapiens
  Payload ID: 6931
  Gene Symbol: GRM7
  Gene Name: glutamate receptor, metabotropic 7
  ENST ID: ENST00000440923
  CDS Start-End: 150-2891
ggtcgcccctccccggattcccccaccctccgtgcctgcaggagcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacaatttttttttttggctgtacagtggaacttggattacactttaaattaactttctctaggaatcaaagtaacctctgaggacctcagcttgcacaaagaggattgagataacatttccaaagcttgttcttcttgagctgacccaacacttaggaaaacatgacatggatcagcaactccattttctgtgagaagtgcaactgctactgaccatctgcactggcatctagtcaagcgattg

SEQ ID NO: 137559 - DNA, 4241 bp, Homo sapiens
  Payload ID: 6931
  Gene Symbol: GRM7
  Gene Name: glutamate receptor, metabotropic 7
  Uniprot ID: Q14831
  ENST ID: ENST00000486284
  CDS Start-End: 275-3043
agtgctgggctgttggagagagcgagcagcaagccggtgagcgcgagcgcggcgcgccggccggctaacccgagagcgcgaggcgccccaggctggcaggcgccgcgggacccctcaccctctctggtcgcccctccccggattcccccaccctccgtgcctgcaggagcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacaactgtataccaccagtaagaaagagtgtacaaaagtctgttacttggtacactatcccaccaacagtatagcttttgactgctttcccaaaggccctgctgcaaaaaagaagtatgtcagttataataacctggttatctaacctgttccattccatggaaccatggaggaggaagaccctcagttattttgtcacccaacctggcataggactctttggtcctacccgcttcccatcaccggaggagcttccccggccgggagaccagtgttagaggatccaagcgacctaaacagctgctttatgaaatatccttactttatctgggcttaataagtcactgacatcagcactgccaactcggctgcaattgtggaccttccctaccaaagggagtgttgaaactcaagtcccgccctggctctttagaatggaccactgagagccacaggaccgttttggggctgacctgtcttattacgtatgtacttctaggttgcaaggttttgaaattttctgtacagtttgtgaggacctttgcactttgccatctgatgtcgtacctcggttcactgtttgttttcgaatgccttgttttcatagagccctattctctcagacggtggaatatttggaaaaattttaaaacaattaaaattttaaagcaatcttggcagactaaaacaagtacatctgtacatgactgtataattacgattatagtaccactgcacatcatgtttttttttttaagacaaaaaagatgtttaaagaccaaaaactgtgctgagaaagtatgccccacctatctttggtatatgataggttacataaaaggaaggtattggctgaactgaatagaggtcttgatctttggaatgcatgccagtaatgtattttacagtacatgtttattatgttcaatatttgtatttgtgttctcttttgttatttttaattagggtatatgaatattttgcaataattttaataattattaagctgtttgaaggaaagaatatggatttttcatgtcttgaggttttgttcatgccccctttgactgatcagtgtgataaggactttaggaaaaaaagcatgtatgttttttactgtttgtaataagtactttcgttaatcttgctgcttatgtgccaatttagtggaaaaaaacaacccttgctgaaaaattccctctttccattctctttcaattctgtgatattgtccaagaatgtatcaataaaatactttggttaactttttta

SEQ ID NO: 137560 - DNA, 3289 bp, Homo sapiens
  Payload ID: 6931
  Gene Symbol: GRM7
  Gene Name: glutamate receptor, metabotropic 7
  Uniprot ID: Q14831
  ENST ID: ENST00000467425
  CDS Start-End: 275-3043
agtgctgggctgttggagagagcgagcagcaagccggtgagcgcgagcgcggcgcgccggccggctaacccgagagcgcgaggcgccccaggctggcaggcgccgcgggacccctcaccctctctggtcgcccctccccggattcccccaccctccgtgcctgcaggagcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacaactgtataccaccagtaagaaagagtgtacaaaagtctgttacttggtacactatcccaccaacagtatagcttttgactgctttcccaaagatttttttttttggctgtacagtggaacttggattacactttaaattaactttctctaggaatcaaagtaacctctgaggacctcagcttgcacaaagaggattgagataacatttccaaagcttgttcttcttgagctgacccaacacttaggaaaacatgacatggatcagcaactccattttctgtgagaagtgcaactgctactgaccatctgcactggca

SEQ ID NO: 137561 - DNA, 4057 bp, Homo sapiens
  Payload ID: 6932
  Gene Symbol: GRM8
  Gene Name: glutamate receptor, metabotropic 8
  Uniprot ID: O00222
  ENST ID: ENST00000339582
  CDS Start-End: 810-3536
gatttttaaaaatcagaactattgacatttctggtctcctcgtcgcttcaggctgaagagcggagggggatccgcgggccgagggtccccctccctgcccgcgccagggccgctgggtgacaccgaaatccagaggctcccgcccctcgggggttcctcctcccgcttcccgaggtgactggttggcgcgaagcgattggcgatcccgggcgcgatcctggccgcggctccccgcgccgcgccgggtgaatggccgcgggcggaggatcgggaggcgccgggcgcagaccaatcgcggccgccggtgggagtatttgttattcacatggaagagacttggcgcctgctaggccagctcagccccctcagcccagagatcagccacaagtgcggccgctgtgctcgcctcacgcggcggcggcggcggcggcggcggcgctgacatggagctgcgggcccccggcgggcttcctcaccgcgccctctgcggggagcagggaataattctgctacaaggctgatttcaaggacatgaattgttgacctcatcccaacatcagaacctcagatgttctaatttttgcaccattccaggcaagttgatcttataaggaaataaaattgaaccttaggggtctgatggaaattcactgtgacattcaaatcaagaaaacttgctaatgcccacagagccttttccccatgggccctgatggtagcctccagaaggtgcagcctcaggtggtgccctttcttctgtggcaagaataaactttgggtcttggattgcaataccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagcaaaaaaactaaaccaaagtgggcattttctctggattggctcagatagttggggatccaaaatagcacctgtctatcagcaagaggagattgcagaaggggctgtgacaattttgcccaaacgagcatcaattgatggatttgatcgatactttagaagccgaactcttgccaataatcgaagaaatgtgtggtttgcagaattctgggaggagaattttggctgcaagttaggatcacatgggaaaaggaacagtcatataaagaaatgcacagggctggagcgaattgctcgggattcatcttatgaacaggaaggaaaggtccaatttgtaattgatgctgtatattccatggcttacgccctgcacaatatgcacaaagatctctgccctggatacattggcctttgtccacgaatgagtaccattgatgggaaagagctacttggttatattcgggctgtaaattttaatggcagtgctggcactcctgtcacttttaatgaaaacggagatgctcctggacgttatgatatcttccagtatcaaataaccaacaaaagcacagagtacaaagtcatcggccactggaccaatcagcttcatctaaaagtggaagacatgcagtgggctcatagagaacatactcacccggcgtctgtctgcagcctgccgtgtaagccaggggagaggaagaaaacggtgaaaggggtcccttgctgctggcactgtgaacgctgtgaaggttacaactaccaggtggatgagctgtcctgtgaactttgccctctggatcagagacccaacatgaaccgcacaggctgccagcttatccccatcatcaaattggagtggcattctccctgggctgtggtgcctgtgtttgttgcaatattgggaatcatcgccaccacctttgtgatcgtgacctttgtccgctataatgacacacctatcgtgagggcttcaggacgcgaacttagttacgtgctcctaacggggatttttctctgttattcaatcacgtttttaatgattgcagcaccagatacaatcatatgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagagcagcggacactagatccagagaaggccaggggagtgctcaagtgtgacatttctgatctctcactcatttgttcacttggatacagtatcctcttgatggtcacttgtactgtttatgccattaaaacgagaggtgtcccagagactttcaatgaagccaaacctattggatttaccatgtataccacctgcatcatttggttagctttcatccccatcttttttggtacagcccagtcagcagaaaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacacttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaaggaatgttttgcaaatgtt

SEQ ID NO: 137562 - DNA, 3240 bp, Homo sapiens
  Payload ID: 6932
  Gene Symbol: GRM8
  Gene Name: glutamate receptor, metabotropic 8
  Uniprot ID: O00222
  ENST ID: ENST00000341617
  CDS Start-End: 16-1521
ccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagcaaaaaaactaaaccaaagtgggcattttctctggattggctcagatagttggggatccaaaatagcacctgtctatcagcaagaggagattgcagaaggggctgtgacaattttgcccaaacgagcatcaattgatggatttgatcgatactttagaagccgaactcttgccaataatcgaagaaatgtgtggtttgcagaattctgggaggagaattttggctgcaagttaggatcacatgggaaaaggaacagtcatataaagaaatgcacagggctggagcgaattgctcgggattcatcttatgaacaggaaggaaaggtccaatttgtaattgatgctgtatattccatggcttacgccctgcacaatatgcacaaagatctctgccctggatacattggcctttgtccacgaatgagtaccattgatgggaaagagctacttggttatattcgggctgtaaattttaatggttgccgaagagggatccagatgtctctaccctggccaactctttttactccttcattttccagtagttgggcagtgctggcactcctgtcacttttaatgaaaacggagatgctcctggacgttatgatatcttccagtatcaaataaccaacaaaagcacagagtacaaagtcatcggccactggaccaatcagcttcatctaaaagtggaagacatgcagtgggctcatagagaacatactcacccggcgtctgtctgcagcctgccgtgtaagccaggggagaggaagaaaacggtgaaaggggtcccttgctgctggcactgtgaacgctgtgaaggttacaactaccaggtggatgagctgtcctgtgaactttgccctctggatcagagacccaacatgaaccgcacaggctgccagcttatccccatcatcaaattggagtggcattctccctgggctgtggtgcctgtgtttgttgcaatattgggaatcatcgccaccacctttgtgatcgtgacctttgtccgctataatgacacacctatcgtgagggcttcaggacgcgaacttagttacgtgctcctaacggggatttttctctgttattcaatcacgtttttaatgattgcagcaccagatacaatcatatgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagagcagcggacactagatccagagaaggccaggggagtgctcaagtgtgacatttctgatctctcactcatttgttcacttggatacagtatcctcttgatggtcacttgtactgtttatgccattaaaacgagaggtgtcccagagactttcaatgaagccaaacctattggatttaccatgtataccacctgcatcatttggttagctttcatccccatcttttttggtacagcccagtcagcagaaaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacacttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccc

SEQ ID NO: 137563 - DNA, 3850 bp, Homo sapiens
  Payload ID: 6932
  Gene Symbol: GRM8
  Gene Name: glutamate receptor, metabotropic 8
  Uniprot ID: O00222
  ENST ID: ENST00000358373
  CDS Start-End: 565-3291
acattacagtaaagaggttcagaaaagagggagactttacccggaactcccaaggcttggagatgtgatcccccaaaagtttagtcggcgaatgggagactgaagggtgacgggaagggggcaggcgcgctcggcgctctgactgggcgtgcggcggcaggattttaaagcgctctgcctcggatcgtctgccctgggtgacctcccggacctgccctggtggaatccggacttgccccgccgagatgacgaggaataattctgctacaaggctgatttcaaggacatgaattgttgacctcatcccaacatcagaacctcagatgttctaatttttgcaccattccaggcaagttgatcttataaggaaataaaattgaaccttaggggtctgatggaaattcactgtgacattcaaatcaagaaaacttgctaatgcccacagagccttttccccatgggccctgatggtagcctccagaaggtgcagcctcaggtggtgccctttcttctgtggcaagaataaactttgggtcttggattgcaataccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagcaaaaaaactaaaccaaagtgggcattttctctggattggctcagatagttggggatccaaaatagcacctgtctatcagcaagaggagattgcagaaggggctgtgacaattttgcccaaacgagcatcaattgatggatttgatcgatactttagaagccgaactcttgccaataatcgaagaaatgtgtggtttgcagaattctgggaggagaattttggctgcaagttaggatcacatgggaaaaggaacagtcatataaagaaatgcacagggctggagcgaattgctcgggattcatcttatgaacaggaaggaaaggtccaatttgtaattgatgctgtatattccatggcttacgccctgcacaatatgcacaaagatctctgccctggatacattggcctttgtccacgaatgagtaccattgatgggaaagagctacttggttatattcgggctgtaaattttaatggcagtgctggcactcctgtcacttttaatgaaaacggagatgctcctggacgttatgatatcttccagtatcaaataaccaacaaaagcacagagtacaaagtcatcggccactggaccaatcagcttcatctaaaagtggaagacatgcagtgggctcatagagaacatactcacccggcgtctgtctgcagcctgccgtgtaagccaggggagaggaagaaaacggtgaaaggggtcccttgctgctggcactgtgaacgctgtgaaggttacaactaccaggtggatgagctgtcctgtgaactttgccctctggatcagagacccaacatgaaccgcacaggctgccagcttatccccatcatcaaattggagtggcattctccctgggctgtggtgcctgtgtttgttgcaatattgggaatcatcgccaccacctttgtgatcgtgacctttgtccgctataatgacacacctatcgtgagggcttcaggacgcgaacttagttacgtgctcctaacggggatttttctctgttattcaatcacgtttttaatgattgcagcaccagatacaatcatatgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagagcagcggacactagatccagagaaggccaggggagtgctcaagtgtgacatttctgatctctcactcatttgttcacttggatacagtatcctcttgatggtcacttgtactgtttatgccattaaaacgagaggtgtcccagagactttcaatgaagccaaacctattggatttaccatgtataccacctgcatcatttggttagctttcatccccatcttttttggtacagcccagtcagcagaaaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacagtaagtcatctgtagagtttccgatggtcaagagcgggagcacttcctaatagatcttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaagg

SEQ ID NO: 137564 - DNA, 551 bp, Homo sapiens
  Payload ID: 6932
  Gene Symbol: GRM8
  Gene Name: glutamate receptor, metabotropic 8
  ENST ID: ENST00000412160
  CDS Start-End: 490-551
aagaatacactagagtctgggctactaccgcgattgaatacaaatcctgccaactgacagaactggaaaacagggttggtggtggagatacaagaaaaatcatgaacgggagaaaagcattcctatggtagcttgtattttgcttgaaagaaaaatagagaaaaagagccaccagcaggaataattctgctacaaggctgatttcaaggacatgaattgttgacctcatcccaacatcagaacctcagatgttctaatttttgcaccattccaggcaagttgatcttataaggaaataaaattgaaccttaggggtctgatggaaattcactgtgacattcaaatcaagaaaacttgctaatgcccacagagccttttccccatgggccctgatggtagcctccagaaggtgcagcctcaggtggtgccctttcttctgtggcaagaataaactttgggtcttggattgcaataccacctgtggagaaaatggtatgcgagggaaagcgatcagcctcttgcccttgtttcttcctcttgaccgccaagtt

SEQ ID NO: 137565 - DNA, 1251 bp, Homo sapiens
  Payload ID: 6932
  Gene Symbol: GRM8
  Gene Name: glutamate receptor, metabotropic 8
  ENST ID: ENST00000444921
  CDS Start-End: 1-1251
aattttttatacccacaggtggaagacatgcagtgggctcatagagaacatactcacccggcgtctgtctgcagcctgccgtgtaagccaggggagaggaagaaaacggtgaaaggggtcccttgctgctggcactgtgaacgctgtgaaggttacaactaccaggtggatgagctgtcctgtgaactttgccctctggatcagagacccaacatgaaccgcacaggctgccagcttatccccatcatcaaattggagtggcattctccctgggctgtggtgcctgtgtttgttgcaatattgggaatcatcgccaccacctttgtgatcgtgacctttgtccgctataatgacacacctatcgtgagggcttcaggacgcgaacttagttacgtgctcctaacggggatttttctctgttattcaatcacgtttttaatgattgcagcaccagatacaatcatatgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagagcagcggacactagatccagagaaggccaggggagtgctcaagtgtgacatttctgatctctcactcatttgttcacttggatacagtatcctcttgatggtcacttgtactgtttatgccattaaaacgagaggtgtcccagagactttcaatgaagccaaacctattggatttaccatgtataccacctgcatcatttggttagctttcatccccatcttttttggtacagcccagtcagcagaaaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacacttcctctaccaagacaacatatatcagttacagcaatcattcaatctga

SEQ ID NO: 137566 - DNA, 1247 bp, Homo sapiens
  Payload ID: 6932
  Gene Symbol: GRM8
  Gene Name: glutamate receptor, metabotropic 8
  ENST ID: ENST00000457830
  CDS Start-End: 367-1247
gcccaaactgtgaagcctggtgtcagagagtgtctgcgcacccaagatagcgggggaataattctgctacaaggctgatttcaaggacatgaattgttgacctcatcccaacatcagaacctcagatgttctaatttttgcaccattccaggcaagttgatcttataaggaaataaaattgaaccttaggggtctgatggaaattcactgtgacattcaaatcaagaaaacttgctaatgcccacagagccttttccccatgggccctgatggtagcctccagaaggtgcagcctcaggtggtgccctttcttctgtggcaagaataaactttgggtcttggattgcaataccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagc

SEQ ID NO: 137567 - DNA, 429 bp, Homo sapiens
  Payload ID: 6932
  Gene Symbol: GRM8
  Gene Name: glutamate receptor, metabotropic 8
  ENST ID: ENST00000465844
  CDS Start-End: 1-276
tttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggttatccatccctgtttgggattcagggctgccttcatgaatgttttgctatactatgtcaagttgtttaccaatttctgcttctaatgcagctgtcagatgctcaaactgtctattagtcgaagaggctctctactgaccacctttctcaagtttcttcttcttacatacaatgtttttgacaagactaagcatatcaaaccatcttttaacaattgtaaagcctaatattggccagcatacaattcaattcattaaacattgtagcactg

SEQ ID NO: 137568 - DNA, 3650 bp, Homo sapiens
  Payload ID: 6932
  Gene Symbol: GRM8
  Gene Name: glutamate receptor, metabotropic 8
  Uniprot ID: O00222
  ENST ID: ENST00000472701
  CDS Start-End: 609-3335
gatcccgggcgcgatcctggccgcggctccccgcgccgcgccgggtgaatggccgcgggcggaggatcgggaggcgccgggcgcagaccaatcgcggccgccggtgggagtatttgttattcacatggaagagacttggcgcctgctaggccagctcagccccctcagcccagagatcagccacaagtgcggccgctgtgctcgcctcacgcggcggcggcggcggcggcggcggcgctgacatggagctgcgggcccccggcgggcttcctcaccgcgccctctgcggggagcagggaataattctgctacaaggctgatttcaaggacatgaattgttgacctcatcccaacatcagaacctcagatgttctaatttttgcaccattccaggcaagttgatcttataaggaaataaaattgaaccttaggggtctgatggaaattcactgtgacattcaaatcaagaaaacttgctaatgcccacagagccttttccccatgggccctgatggtagcctccagaaggtgcagcctcaggtggtgccctttcttctgtggcaagaataaactttgggtcttggattgcaataccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagcaaaaaaactaaaccaaagtgggcattttctctggattggctcagatagttggggatccaaaatagcacctgtctatcagcaagaggagattgcagaaggggctgtgacaattttgcccaaacgagcatcaattgatggatttgatcgatactttagaagccgaactcttgccaataatcgaagaaatgtgtggtttgcagaattctgggaggagaattttggctgcaagttaggatcacatgggaaaaggaacagtcatataaagaaatgcacagggctggagcgaattgctcgggattcatcttatgaacaggaaggaaaggtccaatttgtaattgatgctgtatattccatggcttacgccctgcacaatatgcacaaagatctctgccctggatacattggcctttgtccacgaatgagtaccattgatgggaaagagctacttggttatattcgggctgtaaattttaatggcagtgctggcactcctgtcacttttaatgaaaacggagatgctcctggacgttatgatatcttccagtatcaaataaccaacaaaagcacagagtacaaagtcatcggccactggaccaatcagcttcatctaaaagtggaagacatgcagtgggctcatagagaacatactcacccggcgtctgtctgcagcctgccgtgtaagccaggggagaggaagaaaacggtgaaaggggtcccttgctgctggcactgtgaacgctgtgaaggttacaactaccaggtggatgagctgtcctgtgaactttgccctctggatcagagacccaacatgaaccgcacaggctgccagcttatccccatcatcaaattggagtggcattctccctgggctgtggtgcctgtgtttgttgcaatattgggaatcatcgccaccacctttgtgatcgtgacctttgtccgctataatgacacacctatcgtgagggcttcaggacgcgaacttagttacgtgctcctaacggggatttttctctgttattcaatcacgtttttaatgattgcagcaccagatacaatcatatgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagagcagcggacactagatccagagaaggccaggggagtgctcaagtgtgacatttctgatctctcactcatttgttcacttggatacagtatcctcttgatggtcacttgtactgtttatgccattaaaacgagaggtgtcccagagactttcaatgaagccaaacctattggatttaccatgtataccacctgcatcatttggttagctttcatccccatcttttttggtacagcccagtcagcagaaaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacagtaagtcatctgtagagtttccgatggtcaagagcgggagcacttcctaatagattccacccaggaaaaagcacatgataacaatacacagaaatctgtgctcaaccagtagaatttaactgatctattgaagcccatcttggtatctatgaaagagtggcaaataatttgaagatttgtatggtaaaataccaggaagctgaatatggtaaacattacaacctttaccttactaggttctacagatgaatcaaaaaagaaagaaaagcaaagcttcctctaccaagacaacatatatcagttacagcaatcattcaatctgaaacagggaaatggcacaatctgaagagatgtggtatatgatc

SEQ ID NO: 137569 - DNA, 4719 bp, Homo sapiens
  Payload ID: 6933
  Gene Symbol: GLUL
  Gene Name: glutamate-ammonia ligase
  Uniprot ID: P15104
  ENST ID: ENST00000311223
  CDS Start-End: 898-2019
gtaaaactattccccgtgaaggcggcagggcagaggtccagggcgggctttgctgggagcctcgggaccccgggttgggggccgtggggcggcacctggcgagctggcgggtgggcggcgagccgaggcttcccggcctggcggcaactcgcccctctgccctcagccctcccggctccgctcccttcccccacgccgccctgcccctcccccacgcccctttctctttctttctttctttcccagttcgcttgcccccaccccagcggcgcccgccgggctcctcgcccaatggccgcggggcccgggaccgcatcagctgatcggcccgggctcctggccgctgggagccaatcagggcaccgggggcggccccgggccgcggataaagggtgcggggctgctggcggctctgcagagtcgagagtgggagaagagcggagcgtgtgagcagtactgcggcctcctctcctctcctaacctcgctctcgcggcctagctttacccgcccgcctgctcggcgaccagcggggatcctcccccagccgcaagtccacgaagaaagcaacgaatgaaaattatgaagacaacgagaagtcagactcctccgggtcgcgctccagctgcttcggcttcgtcgcctactctgtgaactccggggagagatctcgagtcaagattaagaccttaacccaccaacctgcctgttcggacaccccccgggccggccgctgtctgtccccttctccatcgccctctcccagaaagctccggtgcttggaccagctagagtctgagaaagaggagaggcgcgaacgccactccaaaaagagaagggttaaagagggcaaccctaacgatacgcttgactttctgtggctgggaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagatctctctgatgtgtttgtgattctttcaaatccctatgtgccattatatttctttatttcctaaaacaggcaaaataagctcaagtttatgtactctgagtttttaaaacactggagtgatgttgctgaccagccgtttcctgtacctctctaagttgggtatttgggacttaagggattaagtttttcacctagacttagttacacacaatcttggcatttcctagcctagaggtttgtagcagggtacaagccccactcctcccccttcctttgctcccctgagtttggttttggcttaccataacattgttttgaccattcctagcctaatacaatagcctaacataatgtaagattaactggctttacgatttctattctctgctctcagtgataagaaacaaatattagctaccctgctaccctggttgaagccttccaaggctggctatgccctaggcatgggctcatccttgggtgtatcttgccttgcaggaagaccagtggaccgattgtgattctcaaaagctctgtgttgtcacctgtgcccttgccccttgctcttatcttggtccgtgtatctgggagttcttccaccttatcttggccaattcctaccttcgttcattcctcatgaggttgggtaaaagctccctccggctcccatgatgctgtgcatatacctagcaaaaagcaattattggacacattggagtgcaatattattaatagcattaatactactaataatgtgggcaatagtgattgtttttaaaaggcagtatactcttaccagtgcgaggtagctggggcctgtgatagtttttagagataagttcttcaggcaactgtgtattttacactagtcaagtaatcctagatatccgtggtttttcttaagaaagttggctcgtaatatgatttaatattcaaagtagagtcatctacctattagcttgctggcgtggtcctagtttatgcctgtttcagcatgattgttgagtaccctgtttcatccttagcattttcttgattttgttgttaaatgatgtatacccttatttccattgaatctgtgcttccacccccccaactgaagttgtcttccctttgcttggccacccttacagcctcttggatggtgtatcctacagtgtaagcactaaactgaagaggcagtgacctg

SEQ ID NO: 137570 - DNA, 3942 bp, Homo sapiens
  Payload ID: 6933
  Gene Symbol: GLUL
  Gene Name: glutamate-ammonia ligase
  Uniprot ID: P15104
  ENST ID: ENST00000339526
  CDS Start-End: 1310-2431
gcagagtcgagagtgggagaagagcggagcgtgtgagcagtactgcggcctcctctcctctcctaacctcgctctcgcggcctagctttacccgcccgcctgctcggcgaccaggtaagcccccggacggcccggtgtcacgcaagcgaggcgcgccgcccctgctaccccgcgaggcgcgccgcccagcctcttttttcggctgcctgcccctccagtcccagccctacgctgcggcctctccggcccatgcctgagatccggcatgagtgctcctcccgcgtgcttccgccgctggtggcttggacccgtcggggctggcgctggtggggcgcgcccttggccaggctctgggaagggcggggtgagttgttttgatcttcttttcactacttgcggccgaagcgccgcccctggaggccgttgggccggcctgcgccctggggctcgcagtggtttgtttgcgctgtggatggagtggcggtgcggtcccctgtggagcgcaaacaaggcgcttggttggcgcgggcgcctggctgccttcctcgtggtggggccttcggagcaatcgtcctggttctggcgatggttgagacgcctcgattgcggcgtgtaacggtgagcgttgtttgggcggccggctcccgcctcggggtcccgggggccttccaatgtgaccgaacaatggagagcccgggcctcggcgcagtcagtggagaagccggtccgggcggaggcagcagcagcgcgcagtccctacggcctgcgcccccaccctcccccggaccccccaacccctcggcggcagggtatggccacctccgtgaggccctgagattcggacgggggcccgaggggcagggcgcccactttagggacatttcagtgggaaggggctgctctcaaagtggataattataactccctcgggggcgggaagcggggatcctcccccagccgcaagtccacgaagaaagcaacgaatgaaaattatgaagacaacgagaagtcagactcctccgggtcgcgctccagctgcttcggcttcgtcgcctactctgtgaactccggggagagatctcgagtcaagattaagaccttaacccaccaacctgcctgttcggacaccccccgggccggccgctgtctgtccccttctccatcgccctctcccagaaagctccggtgcttggaccagctagagtctgagaaagaggagaggcgcgaacgccactccaaaaagagaagggttaaagagggcaaccctaacgatacgcttgactttctgtggctgggaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataaga

SEQ ID NO: 137571 - DNA, 4364 bp, Homo sapiens
  Payload ID: 6933
  Gene Symbol: GLUL
  Gene Name: glutamate-ammonia ligase
  Uniprot ID: P15104
  ENST ID: ENST00000331872
  CDS Start-End: 542-1663
gtaaaactattccccgtgaaggcggcagggcagaggtccagggcgggctttgctgggagcctcgggaccccgggttgggggccgtggggcggcacctggcgagctggcgggtgggcggcgagccgaggcttcccggcctggcggcaactcgcccctctgccctcagccctcccggctccgctcccttcccccacgccgccctgcccctcccccacgcccctttctctttctttctttctttcccagttcgcttgcccccaccccagcggcgcccgccgggctcctcgcccaatggccgcggggcccgggaccgcatcagctgatcggcccgggctcctggccgctgggagccaatcagggcaccgggggcggccccgggccgcggataaagggtgcggggctgctggcggctctgcagagtcgagagtgggagaagagcggagcgtgtgagcagtactgcggcctcctctcctctcctaacctcgctctcgcggcctagctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagatctctctgatgtgtttgtgattctttcaaatccctatgtgccattatatttctttatttcctaaaacaggcaaaataagctcaagtttatgtactctgagtttttaaaacactggagtgatgttgctgaccagccgtttcctgtacctctctaagttgggtatttgggacttaagggattaagtttttcacctagacttagttacacacaatcttggcatttcctagcctagaggtttgtagcagggtacaagccccactcctcccccttcctttgctcccctgagtttggttttggcttaccataacattgttttgaccattcctagcctaatacaatagcctaacataatgtaagattaactggctttacgatttctattctctgctctcagtgataagaaacaaatattagctaccctgctaccctggttgaagccttccaaggctggctatgccctaggcatgggctcatccttgggtgtatcttgccttgcaggaagaccagtggaccgattgtgattctcaaaagctctgtgttgtcacctgtgcccttgccccttgctcttatcttggtccgtgtatctgggagttcttccaccttatcttggccaattcctaccttcgttcattcctcatgaggttgggtaaaagctccctccggctcccatgatgctgtgcatatacctagcaaaaagcaattattggacacattggagtgcaatattattaatagcattaatactactaataatgtgggcaatagtgattgtttttaaaaggcagtatactcttaccagtgcgaggtagctggggcctgtgatagtttttagagataagttcttcaggcaactgtgtattttacactagtcaagtaatcctagatatccgtggtttttcttaagaaagttggctcgtaatatgatttaatattcaaagtagagtcatctacctattagcttgctggcgtggtcctagtttatgcctgtttcagcatgattgttgagtaccctgtttcatccttagcattttcttgattttgttgttaaatgatgtatacccttatttccattgaatctgtgcttccacccccccaactgaagttgtcttccctttgcttggccacccttacagcctcttggatggtgtatcctacagtgtaagcactaaactgaagaggcagtgacctga

SEQ ID NO: 137572 - DNA, 4065 bp, Homo sapiens
  Payload ID: 6933
  Gene Symbol: GLUL
  Gene Name: glutamate-ammonia ligase
  Uniprot ID: P15104
  ENST ID: ENST00000417584
  CDS Start-End: 244-1365
actacttgcggccgaagcgccgcccctggaggccgttgggccggcctgcgccctggggctcgcagtggtttgtttgcgctgtggatggagtggcggtgcggtcccctgtggagcgcaaacaaggcgcttggttggcgcgggcgcctggctgccttcctcgtggtggggccttcggagcaatcgtcctggttctggcgatggttgagacgcctcgattgcggcgtgtaacgaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagatctctctgatgtgtttgtgattctttcaaatccctatgtgccattatatttctttatttcctaaaacaggcaaaataagctcaagtttatgtactctgagtttttaaaacactggagtgatgttgctgaccagccgtttcctgtacctctctaagttgggtatttgggacttaagggattaagtttttcacctagacttagttacacacaatcttggcatttcctagcctagaggtttgtagcagggtacaagccccactcctcccccttcctttgctcccctgagtttggttttggcttaccataacattgttttgaccattcctagcctaatacaatagcctaacataatgtaagattaactggctttacgatttctattctctgctctcagtgataagaaacaaatattagctaccctgctaccctggttgaagccttccaaggctggctatgccctaggcatgggctcatccttgggtgtatcttgccttgcaggaagaccagtggaccgattgtgattctcaaaagctctgtgttgtcacctgtgcccttgccccttgctcttatcttggtccgtgtatctgggagttcttccaccttatcttggccaattcctaccttcgttcattcctcatgaggttgggtaaaagctccctccggctcccatgatgctgtgcatatacctagcaaaaagcaattattggacacattggagtgcaatattattaatagcattaatactactaataatgtgggcaatagtgattgtttttaaaaggcagtatactcttaccagtgcgaggtagctggggcctgtgatagtttttagagataagttcttcaggcaactgtgtattttacactagtcaagtaatcctagatatccgtggtttttcttaagaaagttggctcgtaatatgatttaatattcaaagtagagtcatctacctattagcttgctggcgtggtcctagtttatgcctgtttcagcatgattgttgagtaccctgtttcatccttagcattttcttgattttgttgttaaatgatgtatacccttatttccattgaatctgtgcttccacccccccaactgaagttgtcttccctttgcttggccacccttacagcctcttggatggtgtatcctacagtgtaagcactaaactgaagaggcagtgacctg

SEQ ID NO: 137573 - DNA, 1244 bp, Homo sapiens
  Payload ID: 6933
  Gene Symbol: GLUL
  Gene Name: glutamate-ammonia ligase
  ENST ID: ENST00000621524
  CDS Start-End: 57-758
aagagggcaaccctaacgatacgcttgactttctgtggctgggaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctc

SEQ ID NO: 137574 - DNA, 3813 bp, Homo sapiens
  Payload ID: 6934
  Gene Symbol: GCLC
  Gene Name: glutamate-cysteine ligase, catalytic subunit
  Uniprot ID: P48506
  ENST ID: ENST00000229416
  CDS Start-End: 485-2398
ataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagattaggctgtcctgggttcacactgcccgaggtcaaacccaacccagtggaaggaggagcttccaagtccctcttctttccagatgaagcaataaacaagcaccctcgcttcagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggttgatgagaacatgaaggtagcacagaaaagagatgctgtcttgcagggaatgttttatttcaggaaagatatttgcaaaggtggcaatgcagtggtggatggttgtggcaaggcccagaacagcacggagctcgctgcagaggagtacaccctcatgagcatagacaccatcatcaatgggaaggaaggtgtgtttcctggactgatcccaattctgaactcttaccttgaaaacatggaagtggatgtggacaccagatgtagtattctgaactacctaaagctaattaagaagagagcatctggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagaaaaatgcattattgacgaactggctacagtaccatgcctctcagccagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctgatggctgttatcaaaggaacttttctttgtttaaatttgctgatgcaggaattaagtttaaacacaactctatagaaagaaaggagattattacccagaattcacatgtagtgattattaaggacaatttttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgttttttttctcaactagttaagtcaactgcttctgaaataactctgtattgtagattatgcagatctttacaggcataaatatttaaactgtaatatgctaacttgaagagattgcaataaagctgcttcagctaaccctgtttatgtttaaatactagggtttgttctatattttatacatgcattttggatgattaaagaatgcctggttttcgtttgcaatttgcttgtgtaaatcaggttgtaaaaaggcagataaattgaaatgtttgtggtatgaggaaataaaagaatggaattagctttcattcagaaa

SEQ ID NO: 137575 - DNA, 1011 bp, Homo sapiens
  Payload ID: 6934
  Gene Symbol: GCLC
  Gene Name: glutamate-cysteine ligase, catalytic subunit
  ENST ID: ENST00000504525
  CDS Start-End: 444-608
tagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtgaccaatttatgacgtttggttgtctgttttagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactgg

SEQ ID NO: 137576 - DNA, 847 bp, Homo sapiens
  Payload ID: 6934
  Gene Symbol: GCLC
  Gene Name: glutamate-cysteine ligase, catalytic subunit
  ENST ID: ENST00000505294
  CDS Start-End: 262-630
tcgacctttccataggatattaagtaggacagaggaaagaagggatggaagtggcactactgactgatcctttctacaggtttccatattatgcatatgaacacttatgtgctgtactgtaaacaaatgtgactgtctggagttactgtggatcctttacagacttcacgtttccctgcctttttcttctggaggccacactgaaaacaagtctggaagaatgttaatttttctcacctttattttcaataggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccaggctgtcctgggttcacactgcccgaggtcaaacccaacccagtggaaggaggagcttccaagtccctcttctttccagatgaagcaataaacaagcaccctcgcttcagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctc

SEQ ID NO: 137577 - DNA, 2356 bp, Homo sapiens
  Payload ID: 6934
  Gene Symbol: GCLC
  Gene Name: glutamate-cysteine ligase, catalytic subunit
  ENST ID: ENST00000514004
  CDS Start-End: 389-1147
aggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagattaggctgtcctgggttcacactgcccgaggtcaaacccaacccagtggaaggaggagcttccaagtccctcttctttccagatgaagcaataaacaagcaccctcgcttcagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtatagtttcaaatatacagagaggcaaagtgttccatccatttctgttttttaacttctttatatatgcatgtttcctgttccaaaaatcacattttaatgaggttgaaatggtagctggtatgcctttctgaaaaacatgaagttatattagtaaattcattggaagctgtctatgactaatagttctacagactctgttgttcaccacaaaggtatatacggtatatatacctttataactgtaatttcagttaacttaaaatgcaatatattctgtcattgtttcccttctctttttatatgcctagtttttactgccatctcgtgacaggctagtgaggtggtttaaatattgttcaaaactctgaaaatgagctctgatggaagtattccaatgattttgtgatccaagggatttgtgcaaagctgtctagcggtacaaaaagaataaatatttagcagcttgtgtttgtcttgcccctgagtaaagtatacaggagcctgtctctgtttacccatttaaaaattttcctggatctgtttaaatgatggtgcccctggcagtgagtgtgtccaagctcacttaggaccagagtggaagagcatggaacccatcaggtggccacacaaaagcctgcagttggcttttggctctgtcactactcaggtttttgggcaactccctttacttcttttggctcagatttttcatcagttgaaagaagggctgatattaagtccccttctaggtctgactctaagctaatatttattttattgccttaactaacagaagtaaaagagagaggctgcttgttatttaatgtccaaggaaattttatccagttgtgattacttcagctgattcaaaacagcgtccttagaggcacagggccgtgcagagcctggacccatgtaagacccctctgagccgccagcctgactgctctcagtgcaaagacccagaacccagccttccttcacctgaaacagctgcagcgtgcacacacacttcttgtgcatatatctctggtctatttattttcaaaactaagtataatccaaattgaatgctggaatcagatttttccattctgaatgtgtttaaataacatggccaaggataatttctttctgttttcttgacatttataggtagtataagatatgtgacttccaaataaacataaaccatcacacttcacgaaaaaa

SEQ ID NO: 137578 - DNA, 542 bp, Homo sapiens
  Payload ID: 6934
  Gene Symbol: GCLC
  Gene Name: glutamate-cysteine ligase, catalytic subunit
  ENST ID: ENST00000514933
  CDS Start-End: 80-542
gtgattcataatcttcactgctcacgccaactgtcatgattgaaagcttgtaacttcaggaaaaacaaaagtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagattaggctgtcctgggttcacactgcccgaggtcaaacccaacccagtggaaggaggagcttccaagtccctcttctttccagatgaagcaataaacaagcaccctcgcttcagtaccttaacaagaaatatccgacataggagaggagaaaaggttgtcatcaatgtaccaatat

SEQ ID NO: 137579 - DNA, 519 bp, Homo sapiens
  Payload ID: 6934
  Gene Symbol: GCLC
  Gene Name: glutamate-cysteine ligase, catalytic subunit
  ENST ID: ENST00000513939
  CDS Start-End: 1-519
aggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagtaccttaacaagaaatatccgacataggagaggagaaaaggttgtcatcaatgtaccaatatttaaggacaagaatacaccatctccatttatagaaacatttactgagg

SEQ ID NO: 137580 - DNA, 329 bp, Homo sapiens
  Payload ID: 6934
  Gene Symbol: GCLC
  Gene Name: glutamate-cysteine ligase, catalytic subunit
  ENST ID: ENST00000514373
  CDS Start-End: 1-282
aatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggtaaggatatgtttctttatggtgatgggtatagatctatctgtagatatatttatttatatatgctatttatttcccacctaatttcatttgaaattgtttaccctttgcaataaaatgtttctccatca

SEQ ID NO: 137581 - DNA, 592 bp, Homo sapiens
  Payload ID: 6934
  Gene Symbol: GCLC
  Gene Name: glutamate-cysteine ligase, catalytic subunit
  ENST ID: ENST00000505197
  CDS Start-End: 539-592
actttgccttcttccatgattggaagcttcctgaggccaccccagagtcagaagccgctatgcttcctggacagcttgcagaacccaatgtgaggaaagtggaatgaacttggactttgaaggcaaactaacctggaatcaaatactggctctgctgtttgcaagtgtgatctttgggtatgcttcctaatctgtgagcttcaacttcctcctctgtaaaccaagatcaaagacaaacagggaaacctacttgtctggtgcccatccccttggcagaacactcctctgaaggatgacagtttggctgtgccagggcagagctgccgacaccaaatgagccttcatagcaactatctgatgaggaactcactggcctacctttccttgacagctggggcctgccagccttgaagcatgactccacaacgcccctacccaaggccatggaggttgctgctgatgagcaagctgttttatatttaatccaggtttctgcttggagaggaagaaggtagaggagccagcgaaggtggaatacatgttggtatcttttgatcatgaaaataaaaaagtccggttggtcctgtctggg

SEQ ID NO: 137582 - DNA, 3694 bp, Homo sapiens
  Payload ID: 6934
  Gene Symbol: GCLC
  Gene Name: glutamate-cysteine ligase, catalytic subunit
  ENST ID: ENST00000616923
  CDS Start-End: 485-2284
ataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggttgatgagaacatgaaggtagcacagaaaagagatgctgtcttgcagggaatgttttatttcaggaaagatatttgcaaaggtggcaatgcagtggtggatggttgtggcaaggcccagaacagcacggagctcgctgcagaggagtacaccctcatgagcatagacaccatcatcaatgggaaggaaggtgtgtttcctggactgatcccaattctgaactcttaccttgaaaacatggaagtggatgtggacaccagatgtagtattctgaactacctaaagctaattaagaagagagcatctggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagaaaaatgcattattgacgaactggctacagtaccatgcctctcagccagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctgatggctgttatcaaaggaacttttctttgtttaaatttgctgatgcaggaattaagtttaaacacaactctatagaaagaaaggagattattacccagaattcacatgtagtgattattaaggacaatttttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgttttttttctcaactagttaagtcaactgcttctgaaataactctgtattgtagattatgcagatctttacaggcataaatatttaaactgtaatatgctaacttgaagagattgcaataaagctgcttcagctaaccctgtttatgtttaaatactagggtttgttctatattttatacatgcattttggatgattaaagaatgcctggttttcgtttgcaatttgcttgtgtaaatcaggttgtaaaaaggcagataaattgaaatgtttgtggtatgaggaaataaaagaatggaattagctttcattc

SEQ ID NO: 137583 - DNA, 4857 bp, Homo sapiens
  Payload ID: 6935
  Gene Symbol: GCLM
  Gene Name: glutamate-cysteine ligase, modifier subunit
  Uniprot ID: P48507
  ENST ID: ENST00000370238
  CDS Start-End: 248-1072
gctgcggccgcagtagccggagccggagccgcagccaccggtgccttcctttcccgccgccgcccagccgccgtccggcctccctcgggcccgagcgcagaccaggctccagccgcgcggcgccggcagcctcgcgctccctctcgggtctctctcgggcctcgggcaccgcgtcctgtggggcggccgcctgcctgcccgcccgcccgcagccccttcgctgcgcggcccctgggcggccgctgccatgggcaccgacagccgcgcggccaaggcgctcctggcgcgggcccgcaccctgcacctgcagacggggaacctgctgaactggggccgcctgcggaagaagtgcccgtccacgcacagcgaggagcttcatgattgtatccaaaaaaccttgaatgaatggagttcccaaatcaacccagatttggtcagggagtttccagatgtcttggaatgcactgtatctcatgcagtagaaaagataaatcctgatgaaagagaagaaatgaaagtttctgcaaaactgttcattgtagaatcaaactcttcatcatcaactagaagtgcagttgacatggcctgttcagtccttggagttgcacagctggattctgtgatcattgcttcacctcctattgaagatggagttaatctttccttggagcatttacagccttactgggaggaattagaaaacttagttcagagcaaaaagattgttgccataggtacctctgatctagacaaaacacagttggaacagctgtatcagtgggcacaggtaaaaccaaatagtaaccaagttaatcttgcctcctgctgtgtgatgccaccagatttgactgcatttgctaaacaatttgacatacagctgttgactcacaatgatccaaaagaactgctttctgaagcaagtttccaagaagctcttcaggaaagcattcctgacattcaagcgcacgagtgggtgccgctgtggctactgcggtattcggtcattgtgaaaagtagaggaattatcaaatcaaaaggctacattttacaagctaaaagaaggggttcttaactgacttaggagcataacttacctgtaatttccttcaatatgagagaaaattgagatgtgtaaaaatctagttactgcctgtaaatggtgtcattgaggcagatattctttcgtcatatttgacagtatgttgtctgtcaagttttaaatacttatcttgcctccatatcaatccattctcatgaacctctgtattgctttccttaaactattgttttctaattgaaattgtctataaagaaaatacttgcaatatatttttcctttatttttatgactaatataaatcaagaaaatttgttgttagatatattttggcctaggtatcagggtaatgtatatacatattttttatttccaaaaaaaattcattaattgcttcttaactcttattataaccaagcaatttaattacaattgttaaaactgaaatactggaagaagatatttttcctgtcattgatgagatatatcagagtaactggagtagctgggatttactagtagtgtaaataaaattcactcttcaatacatgaatggaaacttaaatttttttttatgtgtccttgcttatagtttagctgtaataatttaaccttgtattcttgtgccatattctgtctttttattacttataaagacaaaccaaagtaaatctgaaaggagactagaagctttgaaattattgtttgggggttttataaaagcaactactgtcacctccatccagattcttttaaattattgatccatccatagtatatattgctactcattcaagaatcctcaataagtattgagtatttaccatatgttgggatactgtgggctctggagagaggagggggcaatagagctaggaattaagaatcagttgagtaaaatgtgtaatatttattccccattaataactgactaggaaggactaaaagccagaaaggggatgaaaaaaaaatccttaattcagggccgacattatctacttaaacaactttgagatatggtcttaattattttaaagcagaataatataattgaaagtttatagctaaaagagactatataggtcatttagtataattcttcattagtttacgaaccacaaaattgcaaataaataagctatgaactttgatgtacactataaatctccttaattctataaatttgtgtctgtaacctgaatagtttgaaaacttctttaaaaatctcttgtatttcatccgggcgcagtggctcacacctgtaatcccagcactttgggaggccgaggtgggcagatcacgaggtcaggagtttgagaccagcctgaccaacatggtaaaaccccatctctactaaaatacaaaaattggctgggcgtggtggcactcgcctgtaatctcagctacttgggaggctgaggcaggagaatcgcttgaacccgggaggcggaggttacagtgagccgagatcacatcactgcactccagcctgggcgacagagcgagactccatctcaaaaaaaaaaaaaaactcttgtatctcaatatttttaaaccacaggcctaaataaaactaattttgctcaagttttctcaacctagggaaaaagaactatggttccatattcaaaataaatattatagacccttttcctaagtaggattttgtggtttactgattgggtaatttgatcattaaaattatgtgaaatctgcccgggcacacctcatgcctgtaatcccagcactctgggaggccaaggcagatgatcacctgaggtcaggagttctagaccagcctggctaacatggtgaaaccctgtatctgctaaaaatacaaaaattagccaggcgtggtggcgggctcctgtaatcccagctactttggaggcgaggcacgagaatcgcttgaacctgggaggcggagtttgcagtgagccgagatcacgccattgcactccagcctgggcgacagagcgagactgcgtctcaaaaaaaaaaaaaaaagaaaaattatgtgaaatcatgtgatttgcctgggaaaacttgtttagatattgagctacttatgccttctagcctttatattaattgtatgtaatgttattaaatatatatatagttcatctttacatttggaaatgcccaacatttttttcatataagtccttaaacaagcgttcattttattttaaatctatacagtgaactggccaagatattttaagagggaactttaatatcccatttattgtttttataaccctggacttataaaaatgggttgtttgaagggttattttgaaagtgggggaaaaaaaaacttagttgctaatgtatctaaacttcagcagagctttttggtgatctcctacctgcaccctcaactcttgacaaagaagcaagactatagattcattttctgaaggggatcatgtatggaattttttgatgagtttttacttttacctctctactcttgattttctattattgaatactcttttaaaacactgatttttaaggctttatatatgttttccaggctgatgttcacatctttttttcatgaactatcagaatatagtgaacacttttcaaatatttaaggacttaatgtttaaaaagccataaaatagagagtggtaatactaccaaataattacttaaaactgaaagctaagttatcaatagtttatataagagatgttttctgaggagatgtgcatccagtgagaccaaggtagaaagtttatataattgttttttttccagtaaatatgaaaaaaaaagctgtagcttgtttattacatgtccaaaatacagtggagccttactttaacacaatgtactgtaacttggaatttgttctgttatgagtctatcttgaattcccatccatgaaactgtagtcaccaaaagcaacaagtattttcacatgatgtaaaagaccatactatgatggccattgctagaaattgaatcacaaataatagctaataatttttcatttttcaaaaaagatcatttggatagcagctatgtataaaatggaaaataaaaaattattctattttgcatgaatagttcagactttcccataccacagccaagcagtaactaaaattaggatcttaattttcaatgataaaaggtctaaggttcatttaattatgctcctttaacactgtctttctagatttttcacccagtattttcaaaatttgggaatgtaaacaattgatatatttattgtatgttggctagcagttcatccttctgcaaaatatgcattcagagaaatgtgaagcttgttttaatgaagacttaaaccatttgtgtcatttgtgttttcatattcaaatacaccaaattaaaattctgaacctatatttttcatcattaacttcctaatataccagaacatatacctttttcatgtaaagttggcaatgggatatggcagttttatttttgaaaaatatgtaacatgactttaatatttttatagttttcagaattagaaacataggaagggaaaatgttttaattagataagtcaactttttatgtgtctgtagtggtgtactataatagcaaattataaagcattattaaatgtttataataatttttaatattacctacattatgaatttaactaaaataaagtgtgagttgtatattttttaattgggttgtttcaatagctggaagcatcctgaagcattatattgatttttgaactatttgaactcaaactgagtatgatttgaaaataaattaataatttaaaaaca

SEQ ID NO: 137584 - DNA, 3008 bp, Homo sapiens
  Payload ID: 6935
  Gene Symbol: GCLM
  Gene Name: glutamate-cysteine ligase, modifier subunit
  Uniprot ID: P48507
  ENST ID: ENST00000615724
  CDS Start-End: 294-1052
attgtcttccaggaaacagctccctcagtttggaatcagctctcccgctgcggccgcagtagccggagccggagccgcagccaccggtgccttcctttcccgccgccgcccagccgccgtccggcctccctcgggcccgagcgcagaccaggctccagccgcgcggcgccggcagcctcgcgctccctctcgggtctctctcgggcctcgggcaccgcgtcctgtggggcggccgcctgcctgcccgcccgcccgcagccccttcgctgcgcggcccctgggcggccgctgccatgggcaccgacagccgcgcggccaaggcgctcctggcgcgggcccgcaccctgcacctgcagacggggaacctgctgaactggggccgcctgcggaagaagtgcccgtccacgcacagcgaggaggagtttccagatgtcttggaatgcactgtatctcatgcagtagaaaagataaatcctgatgaaagagaagaaatgaaagtttctgcaaaactgttcattgtagaatcaaactcttcatcatcaactagaagtgcagttgacatggcctgttcagtccttggagttgcacagctggattctgtgatcattgcttcacctcctattgaagatggagttaatctttccttggagcatttacagccttactgggaggaattagaaaacttagttcagagcaaaaagattgttgccataggtacctctgatctagacaaaacacagttggaacagctgtatcagtgggcacaggtaaaaccaaatagtaaccaagttaatcttgcctcctgctgtgtgatgccaccagatttgactgcatttgctaaacaatttgacatacagctgttgactcacaatgatccaaaagaactgctttctgaagcaagtttccaagaagctcttcaggaaagcattcctgacattcaagcgcacgagtgggtgccgctgtggctactgcggtattcggtcattgtgaaaagtagaggaattatcaaatcaaaaggctacattttacaagctaaaagaaggggttcttaactgacttaggagcataacttacctgtaatttccttcaatatgagagaaaattgagatgtgtaaaaatctagttactgcctgtaaatggtgtcattgaggcagatattctttcgtcatatttgacagtatgttgtctgtcaagttttaaatacttatcttgcctccatatcaatccattctcatgaacctctgtattgctttccttaaactattgttttctaattgaaattgtctataaagaaaatacttgcaatatatttttcctttatttttatgactaatataaatcaagaaaatttgttgttagatatattttggcctaggtatcagggtaatgtatatacatattttttatttccaaaaaaaattcattaattgcttcttaactcttattataaccaagcaatttaattacaattgttaaaactgaaatactggaagaagatatttttcctgtcattgatgagatatatcagagtaactggagtagctgggatttactagtagtgtaaataaaattcactcttcaatacatgaatggaaacttaaatttttttttatgtgtccttgcttatagtttagctgtaataatttaaccttgtattcttgtgccatattctgtctttttattacttataaagacaaaccaaagtaaatctgaaaggagactagaagctttgaaattattgtttgggggttttataaaagcaactactgtcacctccatccagattcttttaaattattgatccatccatagtatatattgctactcattcaagaatcctcaataagtattgagtatttaccatatgttgggatactgtgggctctggagagaggagggggcaatagagctaggaattaagaatcagttgagtaaaatgtgtaatatttattccccattaataactgactaggaaggactaaaagccagaaaggggatgaaaaaaaaatccttaattcagggccgacattatctacttaaacaactttgagatatggtcttaattattttaaagcagaataatataattgaaagtttatagctaaaagagactatataggtcatttagtataattcttcattagtttacgaaccacaaaattgcaaataaataagctatgaactttgatgtacactataaatctccttaattctataaatttgtgtctgtaacctgaatagtttgaaaacttctttaaaaatctcttgtatttcatccgggcgcagtggctcacacctgtaatcccagcactttgggaggccgaggtgggcagatcacgaggtcaggagtttgagaccagcctgaccaacatggtaaaaccccatctctactaaaatacaaaaattggctgggcgtggtggcactcgcctgtaatctcagctacttgggaggctgaggcaggagaatcgcttgaacccgggaggcggaggttacagtgagccgagatcacatcactgcactccagcctgggcgacagagcgagactccatctcaaaaaaaaaaaaaaactcttgtatctcaatatttttaaaccacaggcctaaataaaactaattttgctcaagttttctcaacctagggaaaaagaactatggttccatattcaaaataaatattatagacccttttcctaagtaggattttgtggtttactgattgggtaatttgatcattaaaattatgtgaaatctgcccgggcacacctcatgcctgtaatcccagcactctgggaggccaaggcagatgatcacctgaggtcaggagttctagaccagcctggctaacatggtgaaaccctgtatctgctaaaaatacaaaaattagccaggcgtggtggcgggctcctgtaatcccagctactttggaggcgaggcacgagaatcgcttgaacctgggaggcggagtttgcagtgagccgagatcacgccattgcactccagcctgggcg

SEQ ID NO: 137585 - DNA, 1813 bp, Homo sapiens
  Payload ID: 6936
  Gene Symbol: ERICH1
  Gene Name: glutamate-rich 1
  Uniprot ID: Q86X53
  ENST ID: ENST00000262109
  CDS Start-End: 79-1410
aggagggcggaacccggaaggcacggcgctcagctcaggaccgcgcgccgtggtctgaggtccgcggcagggtcccgcatggcggcgcacaggaagcacgtgtttgtggagaaggtgctgcagagactttttcctcctgttccaagtggccaaggaaagagggaaccccagacgctggccgtccaaaatccaccaaagaaagtgacctctgagaaagtgagccagaaacatgctgagcctttgacagacactggctctgagaccccgactgcccgacggctctacactgccagcgggcctcctgagggctacgtcccctgttggccggagcccagcagctgtgggagccccgagaacgcctccagcggggatgacacagaagatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaataagcaaaaataaaaaaaggaaactgaaaaagaaacagcaaattaaaaggaagaaagcagccggcttggcagcaaaggctgctggtgtcagtttcatgtaccagcccgaggacagcagcaatgaaggggaaggcgtgggagaggcttgtgaggaggatggtgtggacaccagcgaggaagacccgacactggccggggaggaagacgttaaagataccagggaggaagatggtgcggacgctagcgaggaagacctgacacgggccaggcaggaagagggtgcggacgccagtgaggaagatccgacaccggccggggaggaagacgttaaagacgccagggaggaggacggtgtggacaccattgaggaagacctgacacgggccggggaggaagacggtaaagacaccagggaggaggacggtgcggacgccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacggtgtctccagagatgcagcttcagctgccctcgcagatgccgctgaggagctgctggaccgccttgcgtcacacagcatgctgccctcagacgtgtccatcctgtaccacatgaaaacgctgctgctcctgcaagatactgagagattgaagcatgctctggaaatgttcccagaacattgcacgatgcctcctgaccatgccagagtaatctcagctttctttagttactggatcacacatatccttcctgagaagagcagtgactaaaatggaatatctctttaagaacagctcctctttaacaaaaaaacttaaaagacaaatgtgagatgggcttagagttagttctctgggaacttgaaagacatttatgccatattatttattcacgtgtttgttcctggtgggcaagatgccatctgaggcttcagatgagaaattggggtaaaatggaaatttttcacttatttgcaattatatatatcttgaattactacataaaacttgattctgtttctctacttattgtaaaaattgaaaatggacattctgttaagttaaatgtatagtttgaagctcatatatttttatgaagttttgaatcaccttgtatctgaaagtctctgctttaagaatgctttctgggtattaaaatgttctagtttaagta

SEQ ID NO: 137586 - DNA, 3170 bp, Homo sapiens
  Payload ID: 6936
  Gene Symbol: ERICH1
  Gene Name: glutamate-rich 1
  ENST ID: ENST00000522893
  CDS Start-End: 1-671
aagatggtgcggacgctagcgaggaagacctgacacgggccaggcaggaagagggtgcggacgccagtgaggaagatccgacaccggccggggaggaagacgttaaagacgccagggaggaggacggtgtggacaccattgaggaagacctgacacgggccggggaggaagacggtaaagacaccagggaggaggacggtgcggacgccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacggtgtctccagagatgcagcttcagctgccctcgcagatgccgctgaggagctgctggaccgccttgcgtcacacagcatgctgccctcagacgtgtccatcctgtaccacatgaaaacgctgctgctcctgcaagatactgagagattgaagcatgctctggaaatgttcccagaacattgcacgatgcctcctggtaagtaccgtacgatttattcaaggtcctgcttaagatactctcatcgaggtttgcctctgaaagacttacacgccaccaaaacagcaatgagttggaaaatatgacactgcacatatggcatgggagaatagagtcccagagagaaacaggcttcctgcatctctgcttgatataaaaatatttcacataatatatgcagaaatgcatgtgcagtctaagtttccggacttgggagctgtcaactcttggagccaaattttcctaagtttaaatagaaatgaattcatttcttcctcttttccttctcctctactgctgtggtagatggtaaatttttgcttacctccaactctctggtaccttattgaacccctgacgtggtgatgacgacttttattttctgccaccttcaccgggcatccttttcatgcaaactgttgtgtgctggagcagctgtgctcatgtcttcccaatgccgtgtgcggtgacacaagctgtggtgagggtattcaggccacagaaacctgcaaatgctgaaaatcagaaattcaggctgttgagccattcacctgcacaccactgagtgcagagcagcccacctggcccagggctggcgtcccagaggaggagtggaggagggtccgtggcacccgtcagtggcacctatcccagaggaggagtgaaggtgggtccgtggcacccgtcccagagaaggagtgaaggaggctctgcagattttgtggagggagtttcagagtaagtgtcgggagtggtttctgtccgtagaaaccacattgctgaggggtcaagaccagcatgttagagaagccaggtagcaaacagttacataaccacggtatgatgatgccgtggcactggtgcagggagccgggggctgcagggaccacaaggctggagtcacagcgtgcagagcatatgggtgctggaggagctgccttcatgcagaacgccctcatccgtcaaggagctgttggctttgtgttgccctgcatggtgctgtgggctgtgcagcctaccactggggaaggctggtggggaccccaccctggggcgcttgctccctagctgaggagctggaaaagaagccagatactcggtgagatgcgtcatagagctgcagatagatcctggagatgaggctgtggaggagcgggaagaggagggtgttgttgcagccaagtgcgcatgcgctgagatgggtgaacccatgtgtttgggaactgcgaggagcccggtggctggaccaggggatggatgtgagttgcagaaggtggagaaggtgaagaggtgacagggccaggcacatgggaggagcccggtggctggaccaggggatgcacgtgacagggcgagaggcattgagtgagtctcagaagggggaaaggtgacaggaccaggcacatgggaccccgggcatgtgagccttgtgggcttctacgcagacagagacaggaggttcctggaagctatgaggcttctgggctgttatcttgaggctggatggaggagatagagaatggagaccagtctggggctgctgaggacctgctgagagatacctgcagcgtggaccaggtgggggtggctgaggatttgccaagaggtacttgcagcatggaccaggttggggttgctgaggacctgctgagaggggcctgcagcgtggaccaaggtgcagccacaggttaggcagctgtagccaacgtccaggtggaccatggaggtagaaccagtgggagctgccgagtggccggtgaggcactgggaggaccaggtcaccgcgaggaggaggaggggctcccagaaagatagggtttgaggtgagaggccctgcccagagcgcagtgctgggcagctatgcaggtgccagtcagacctcaggttccagctgaggctcaagagggccataaggcccggagtgcagggaggagagagatcagggacagtgagtacagatgcccaccaggagcgtgaccagggaccatgagaaacgacactggaggaggaagcagggcccgcgggcgacggaagagagaggaggggccccagcaggaaggtggcagtgctcctgagaaggcacctgtgtgtgcggagagggcggcgttggccccaggcgggcatctgtttctggtgggttgtcaggcctcttacagcaagtacttaacaaacttagatttccataatcagatttatctcaaaccgcaaaaaaaagctgattttattatgttaaactgataggagatttttatgagagatgaaagtaagcgattttaactttttaatttttttaatttttgctctgtttctcacacttgaggcttttctgaaattcaccaaaagagttttggcagttgtggggaatttaccagaaccccccattattaaaacaattggtttcttatattaaaatcatcagacaggttttgtgtacacagacatttatgttaagccactgatagaactaaactgtgtgtaggaacctgttttctctaagaaaggactcctttgagttctgtaggatatgtgcttaaaggttttctgtgtcaagctattttatgaaataaaattttacaaacaatgaa

SEQ ID NO: 137587 - DNA, 1551 bp, Homo sapiens
  Payload ID: 6936
  Gene Symbol: ERICH1
  Gene Name: glutamate-rich 1
  ENST ID: ENST00000522706
  CDS Start-End: 37-1074
gcgcgccgtggtctgaggtccgcggcagggtcccgcatggcggcgcacaggaagcacgatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaataagcaaaaataaaaaaaggaaactgaaaaagaaacagcaaattaaaaggaagaaagcagccggcttggcagcaaaggctgctggtgtcagtttcatgtaccagcccgaggacagcagcaatgaaggggaaggcgtgggagaggcttgtgaggaggatggtgtggacaccagcgaggaagacccgacactggccggggaggaagacgttaaagataccagggaggaagatggtgcggacgctagcgaggaagacctgacacgggccaggcaggaagagggtgcggacgccagtgaggaagatccgacaccggccggggaggaagacgttaaagacgccagggaggaggacggtgtggacaccattgaggaagacctgacacgggccggggaggaagacggtaaagacaccagggaggaggacggtgcggacgccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacggtgtctccagagatgcagcttcagctgccctcgcagatgccgctgaggagctgctggaccgccttgcgtcacacagcatgctgccctcagacgtgtccatcctgtaccacatgaaaacgctgctgctcctgcaagatactgagagattgaagcatgctctggaaatgttcccagaacattgcacgatgcctcctggagtcctaagcagacttaaagccaagaaaataagaagaggaaagagagaggggctgccttaaccagctgtggtgctgacttggacaattccaggtcaagaggaactgtctactttcgactttgtgtgatagtaactttttaagcagtggaccgggagcccaagactcagatgcagcaagctttgcaaggctgacgagagctgagatcttcagtggccgatgggtacagggctgctgggagcgtagccacgtctgctccaaggtggcttgaatgaggcagtgcccaagtccttttgactggctgaggtgagcctgtggctcagtcacagtttgtccctctcctaataagtgcatttcccagacagcagctccttggtgtcatgcaactgaggaacctaattggctgggtgggttgttcccatccaacttccacctgtcacgaaggatgctttttcagatcagtctccacagctaccatcttgtcgggcacagagccgggcatcaacaagtgtatgttgaataaagaatgaattgatgaaa

SEQ ID NO: 137588 - DNA, 3630 bp, Homo sapiens
  Payload ID: 6936
  Gene Symbol: ERICH1
  Gene Name: glutamate-rich 1
  ENST ID: ENST00000523415
  CDS Start-End: 1-373
ttttttgaagtcaacacaggaaatgtatttttatgacggtgtctccagagatgcagcttcagctgccctcgcagatgccgctgaggagctgctggaccgccttgcgtcacacagcatgctgccctcagacgtgtccatcctgtaccacatgaaaacgctgctgctcctgcaagatactgagagattgaagcatgctctggaaatgttcccagaacattgcacgatgcctcctggtgggaagtctgaagctcagagagcctgggccaatggtacaggtcacacagcacatcagtggctacatgtgagctcagacctgggtctgctgctgtctgtcttcccaatatccatgaccttgactgatgcaggtgtctagggatacgtccatccccgtcctgctggagcccagagcacggaagcctggccctccgaggagacagaagggagtgtcggacaccatgacgagagcttggtgagtaccaggccaagctgtgctttcctcctccacggcacagctcgggttggggttccagagggtcccagctggccctggaaggtaccttactctaggcaagaatgaacaggttccaaccgccagcatttccttagctctccctggacagcctccgagattaagagaccaaaaactccatgatgtgatataaatcagcaaatataaaaaacaaaatcttcactctgcaactgagagacaggacaggagtccaggggctcaggatgaggatggcatcgcgatgagagacagacgccagctggaacaccctctaggcaggccaccctctgggcaggccgtcagccacagttccatgtttaggaggaccttgacaaggtcattcataataaaattattccccggcagagcatcacttctcggagggaactgtgtctctgaactgtgttcagtttttgtcccggggagctctgtctggtgctcacctttgtacctgcagcaggtgcactgggcaccatgttattagtgtctcagagctgagttcatgtgcatttcttcacctaagaacccactcacaatgaccccaccccagctcctgcagacccggcagaggctaggacgtggctcaggagacaagtagggtctttagagaagccccccggtcactccctttcaagccataagttcccaggtcctcaatagttggctctgagtagaattgtcagagaatgggattttcttaaccatcacaatttccaagtagactcaggcctaactcccagcaatttgtatgtcagactctacagacaattctgtgctgtctatttttgctcatctttaaaacagccacgaaatatgcagcttcctttccctgagaaaatggcaaagaaaattcaacacagaaggccagggagggtgtgtggaaacgattcacatgttcaaaagatttatatgtgtagaagaaagctgtgaagtgtgaagtatattttctattgtagaatggatgaaaatggaataaaaataatatcctttgctaggcagaataaataacttctttaaacaattttacggcatgaagaaatctggaccagtttattaaatgggatttctgccacaaaccttggaagaatcacatcatcttagcccaaggtgaaaactgtgttgcgtaacaaagaacatgactgcgctccacacatacatcattgcccggcgaggcgggacacaagtcaacgacggaacacttgagacaggcctacaactgtgcacggttcagaagcaggtttaagccatacttgctgcagtgagactacatttctgtctaaagaagatgtccctgacttgatctgtttttcagctccagttcccagatgtgcgtgttgtggtccccaggtatcaactccaaattcctgggagcagtgctctggccgtacctgtctgggtttgttggccagcgctgaatccgcttagccaggagagcatggggtgtgcggggttcggtcagcctcacacacgtggcaggagtttctctctggacggcggccgcccacacctggccgacaggagcctgtcttcagcaactttcagttaacgcgtccctcttgccccatgcttgtcctgccacacaaatgtgaaaatgcaacgttacaaagatctgtgcctcagacaccatttgaacacagagaaactcgtgggcttatgtgactacacttttcaggttacggaatttctttaaggtgtacccttgagtttaatatacttattaataacttatcattacagagaaaaaattaccagaagtacagggtgtttttaacggactttcttctcttgcacattgctgggcatggcgtgtactgtgacagggcggagtgatgggctgagaatgtgtgtgtgtctccaacagttcccaaacgtctacattttcaagaaaaaggcaatctacatcatctggaaaattgtaacttagtaattaattaggataatttccctaggttctctgtgctgcatgagaccacagcgtattcattaaagaggaaagctgaatattggcggaaaacagggttgtaaatttgtaacaagtttttctatcagaaaatgaaatgcaattttctgtcctctctgagcttttaccacatagctcttagcaatgggtgttttttctgtcattccactcaattctcactcgagtaaacctccaagcaataagaatgttgtctttcctgtttagactagactgactacctttccaggacagtccattaagttgatttccaatggtgaagggtcagacacgcctcccctgggcagatcagggatagttcatagcatttgccaaatagctgtctgcagctgcagccatcacctccgtaatcaacactgccattgtctgagccttccctttgcaggaatggtgtcagtgcacccaggcctcgtagagatgacagccaccccaggcactattgtgaccattgctttgatcattgttctgtttatgactgaggaaagcagggcttaggaagactaatcttagttatctctttatcccagcaatcggcacacatctgtggatcaataaacattgtattaaaatgatgaacacaactgatctcccttaacctgattttccaggagtcctaagcagacttaaagccaagaaaataagaagaggaaagagagaggggctgccttaaccagctgtggtgctgacttggacaattccaggtcaagaggaactgtctactttcgactttgtgtgatagtaactttttaagcagtggaccgggagcccaagactcagatgcagcaagctttgcaaggctgacgagagctgagatcttcagtggccgatgggtacagggctgctgggagcgtagccacgtctgctccaaggtggcttgaatgaggcagtgcccaagtccttttgactggctgaggtgagcctgtggctcagtcacagtttgtccctctcctaataagtgcatttcccagacagcagctccttggtgtcatgcaactgaggaacctaattggctgggtgggttgttcccatccaacttccacctgtcacgaaggatgctttttcagatcagtctccacagctaccatcttgtcgggcacagagccgggcatcaacaagtgtatgttgaataaagaatgaattgatg

SEQ ID NO: 137589 - DNA, 58 bp, Homo sapiens
  Payload ID: 6936
  Gene Symbol: ERICH1
  Gene Name: glutamate-rich 1
  ENST ID: ENST00000631596
  CDS Start-End: 37-58
gcgcgccgtggtctgaggtccgcggcagggtcccgcatggcggcgcacaggaagcacg

SEQ ID NO: 137590 - DNA, 100 bp, Homo sapiens
  Payload ID: 6936
  Gene Symbol: ERICH1
  Gene Name: glutamate-rich 1
  ENST ID: ENST00000632053
  CDS Start-End: 79-100
aggagggcggaacccggaaggcacggcgctcagctcaggaccgcgcgccgtggtctgaggtccgcggcagggtcccgcatggcggcgcacaggaagcacg

SEQ ID NO: 137591 - DNA, 601 bp, Homo sapiens
  Payload ID: 6937
  Gene Symbol: ERICH2
  Gene Name: glutamate-rich 2
  Uniprot ID: A1L162
  ENST ID: ENST00000409885
  CDS Start-End: 54-524
gagtcagtctacaggctaggtgcacactggacagtcagggtggttgtgagctgatggagactgtaaatgaaccagaaacaggtgaagtgagcaaagatgcagtcattgtaaagcaggagaaaaataatgaatattgccttcaggatattgatgataaattgtcagaatcagcagaggatgatggtgaagatgataccaatgatgaagatgatgatgaagatagtaaccctaaaaagaatactcaggccccactagagttaatggcagaatttctgagagcagaaatggcccgagagtaccagctggcaaaaaaattatgtcagatgatcctaatctatgaaccagaaaatcctgaggccaaggagtttttcacacttattgaagaaatgttgctgatggagaaaactcagaatcatgagcaagacggtgaaaacagtgatgaagacagcagtggtgagagtaaaggagaaagcgatgaggagctgagtgacgagagctctgacgaaggtgaagatggatcatgagtgttgctgcaatacttgaagcttcatgtattttcattaatgtataccatgcaaatataaagacaagtgacatttta

SEQ ID NO: 137592 - DNA, 7159 bp, Homo sapiens
  Payload ID: 6938
  Gene Symbol: ERICH3
  Gene Name: glutamate-rich 3
  Uniprot ID: Q5RHP9
  ENST ID: ENST00000326665
  CDS Start-End: 220-4812
aacagggaagctgtggataccaacggagggtgggagcccgggaggctgcgggtagcccgggcgcccaggggcggcggcggcccagcccaggtgcccgcgcacaggggacctcggtgcggagccacccctcgagcgcgactgtcgcagcgccagcgcgcacggggccccacgcacccaccctccgcacctgccgcggggtccaaaagggatcctgcaaaaatgagccattctcaccccgctgggttacttgctgcatataatagccttatggataaacacctggctgggtattttaacaatacaaggataaggcgtcatctcttaagatcaggactgatcacaagaagtggaagaatactttctgaaaaagaatataaactaaatatgatgaagcgggatcatcaaaaatatatccgggaatgcttagcccaggcaatttttcataaagttcttgatatggagcgttaccatcagcttgaaataaaaaagaaattggagaccttagctaggaaggagcgaatccagaggtttaagggagagcacacaagaaggtctgttgaaaataacatgccaatcctgtctccccacccaccagttggcccaaagagtaatcgtggccatagtgttctggttgatgaaggacattccagtccgttagcactgacagcccctcgaccatatactgctccaggaaatatgcagcctccaattcgattacagcctcttcccagtaatcctgcagtagaaactgttccaaaggtaacttcaaggtccagatcaaaaacctcattgctggaaaatgaagctctgtttcccattgggggcaagaaggcagtgatgaagttcaggaactccataggcaattcacagagaatgaattcatatcaacttccaaacattaacagttacatgatgcctattcctcctccacttcccccaactgggaaaatcacaagagaaaatagatctgaaacatggagaaggagaagatttcgtccaaccactgctccaaatggcttagaacctcttttgacaaaggattcaagaaggattcataaaacatccttacatagtaatgcagctattacaatgatctatttggggaaaaatgtgcacctatcttctgataatcctgacttccgggatgaaattaaagtttatcagcagcactgtggtggggaaaacctttgtgtctacaaaggcaaactacttgaaaaagagacctttcagtttatttccaaaaggcatcatggtttccccttcagtctcacctttttcctgaatgggatgcaggtgaacaggttaagctcctgttgtgaatacaagcatcggaaaggttccaggcttggaggcaaacgaggctactttgggtttgtgtgtgttgagagatcatctccttgctacaagtgcattattgcaatgggccttgacaaaaaaccgtctttgccgaaatctaggaaagaaaagagcactgagaaaggagaggaactgaagaaggctgaggggaaagtgaggaaagagagagagtatgtgataccaaaaagaaatgagatcaaggagaacaaaacctctgtttcagccaaattttcagctcaagaaataaaaacagggctcaaagaagtggtaactgctgtggaggaaatgacaagtaaaggaaaaccaggacaagaagtcttggaagacgaccaggaaaatactttaaaatatgagtatgaagaagactttgaagtagatgaggagaaacaaggtgaaaaatctaatgaagaaggacaggctgatgttcaaatgaatggaataccgcagtcacctttggatgataaaaaagataatttagaccctgaaaaagagagtgaaacctcatcacagaaggcaccagatgcccgtgacaatgtgaaagatgagaatgatggatgctctgagagtgaactggaagaggataaacaagatatgaaaactgcttcatcaacctcatccagaagtcacccttattctagtgacagtgaggatgaatctgcagtgggggacagggaagcccacactgacagcagcacagatgaaagtgccagaaggtcatcttctcaggaactgagtgaaaatgataagccaagaaagtctcaccttccaattgaggaatccttagaaattgaaattgaagaccaagaaataacaaaagcagatgtggagaccaagccgatgccaatagacgaaagctttgagaatgttcttaaagaaggaacggagaaaggaacccaagagattgcagagggtttatctgagaagtccgggaaacatgtttctgcagaagaaaaggaaaaggataagagtaagctttgggaagaaagcactgctcaggtgaaggacaaaaaggcaggtctccctgggttggaggaaggtggaaaggattcattgccattagcctatgtcctggctcttggtgcaccaacaatgaatttcatggtggatgaaacagcagcaatcaactcaaacaaggaatcccagcaattggtgcaaaaaacgtatacactggagaagaaagaagcaatggaggaagatgaagcgccccagcacagagatgctgacatagtacagggaaaaggggaggcagcactgtggggagaagcaggagctgttcatgaggctcccttgagggcgtggaagccaacagcagagcagccagaattggcagaagagtttacagaaaaaagggagatccctccaggcatagaaaggggggcagagggagcagcagaagcagaaggggtcagaaggctgggtgaaggggggtcagaccccataggacaagcagcagcaaaagatgctgtgggtctgagtaaagatgaggctcctgaaaagcaagccttgatgctcacagtgcttgagacagacaaagcagcttctgaaggggaacagggtttagagaaggcagtgcttgcaaatgaagcagcagccctgaacttggagcatcttcatgaagtagcagccctgagagaggcagcgacatcggaggagggagaggctgagggtggggtggctgtgagtgatgtcggagaaagtgaagaggaagcatccatagacctagaggacacaggacccatggaggacacagcatcaaagagagaggacggttctgaagaggcaattcttgggggagaggaaccagccaaagagagaaaagaggttatgagaacagaaacacgcttgagccccttcacaggagaggcagaggcaagccggatgcaggtttcggagggcagccctgaggaaggaagccttgcaaaggaagccttcctttgcaaggaagatgtggaaggggaagagatggtgactgaggcagaagctaatagggaagatgataggaaagaaattttacccaaggaattagatttagcaagagagcgaaggaaagctgagaggccaaaaacatctctgaggaaaactgactctgagagagaagaggtgacaagggcaaatgcactcaaggatgaagatgcttttaaagaagagcaaaaacttaaagcggaagaaggggaaacagagacagaagtaagagctgaggaagagacaaaagctcccccaaatgaaatgggatctgatgctgagaacgaagcacctgtggaggcttctgagttgtctgacaatccagggcttctaggagaagattcactaaaagagacagtggttcccatatttgaagcaacgcctggatttgaaaagtcgctggaaaacataacagctctgaggaaagaaggaggaggggaaagactgagtgaagccagagacacagagcacaaagacagagaagagctgtccagcagggagaatagggccctgaaggaagggcaccgccaagatggagagggggccttagcagctcctgaagctgagccagcaggaaaggtgcaggcccctgaggggctgatcccagccacaggccaggcagaggagctagcagccaaagatcacgactcctgcgcaggactggaggggagagctgaagggcaaggaggagtggatgtcgtgctaaggacccaggaagctgttgctgaggaagatcccataatggcagaaaagttcagggaggaagcggtggatgaggacccagaggaggaagaggacaaagagtgcactctggagacagaagcgatgcaggacaggaactcggaaggggacggggacatggaaggagaaggaaacacacaaaagaatgagggcatgggaggaggaagggttgtggctgtggaagttctacacggaggtggtgaaacggcagaaacagccgcagaggagagggaggtgttggcaggttcggagacagccgaggagaaaacaatagcaaataaagcctcctccttttcagatgttgctgaggaagaaacctggcaccaacaggatgagttagtaggaaaaacagcagctgcagggaaggtggtggtagaggaattagcacggagtggggaggaagtgccagcagcagaggagatgacagtgacatatacaacagaggctggggtgggcactccaggagccctggagcggaagacctcagggctaggacaggagcaagaggaagggtcagagggccaggaggcagccactgggagtggcgatgggaggcaggagacaggagcagctgaaaaattccgattaggattatcacgggagggagagagggaattgagtccggagagtctacaggcgatggcaacacttccagtgaagcctgatttcactgaaacccgagagaagcaacagcatatggtgcaaggagaaagcgagactgcagatgtttcccccaacaacgtgcaggtctaggagacttgctggcagacagataatttaaagatgtcttctgaagatgtaaagagtggagaaagattcacgcaagcatctcaccaggattcttgattttctctctctcctctttagttgctggttgcgcttgtctgagatgattcccaatctgtcagccctggtcagtagctcagtaagcaccttgagaatagctcaagtagatctgtaggacccttcttagaagcagtggttcctcatggagaaacttgtgaggctgttacacattctacacacctaacattattttcaaacaaaaatgataattttcagatgcttgacttttaccaaagatcactggaaggcccagtcctaatgttaggggtttgtttaaagtcctttttattttacaatacagagccccagtcaattccacaatctcaatttcatacatgggaattttatttaaaaatctgtggtttggggctttaatgaattggcctgtgaaaatgagctctaaatttcctcccacgtacactcaaaactcaagattgctccaaatctctaagttcttccagcaaaagatttcttggcatgtatattcacttatacttagaaatattcattcttttaatttatgccagaataacaaagtggaaatcttatttcaaaatgctctttgtttttttgtgtgtgtttctgtagttctgctttctggggtagactagtaaaatggtagcttccagcattttgtccctggggccttctttatagggccactcaaatttaaataaaagtagtaaataatttagctaagtggaataagtataataattatagtggtaagcatagcacatcagcattatgccaacattctagactctttagttgatgtcattaaatggaaaagaaacttggattaaatgagtgtgctgctcaccttcccaagttctgttatttcaaacctgtgaactaaccttgcagttcattataaatcaacagtaacaactgcattctaaattactccctgatattattttctagttgtgtatcagcctgtctcctaggggttttcatttccctgaagacatacaagtgccccagagcgcatgtatatgtctaccatttctctatatgagaaggtaaaaaaaatttccttaagcagtgattttccagccagaatatacattagattttcatgggacgcttttataaatgactcaacccttttccccaccccagagattcagacttaattcgttttagatggatctacacatcagtatatatatatttttaacttttcacttgattcttctctgtagccaaggttgagaaccgctgttctaaatcatcatataatccatgctggccacattacactcaaggtccctagggaccaggcatattatcatagtaggtattttccattttaatgtgtaatggagccattcaatgatcaaaaatacactggaccagatagtagactggtcccttgatcagaagcatcagcacatcagcatcacctggaaattgttcccagcctttgtctcctacctactaaattagaaactcttggtgggttccagtaatccatagcttaacaagccctgcagttaatactgatgtacactgatgtccaaaaactgctgtcatggactattgattgtattgaggattagtctcagttggaaagccaactacagaggcattttgaactttctttctttgcctctctatgtctctctgtcttttcctgtcttctgatttatctgtctttctttctctagtaaatggcactcaatataaaagtggtggagtcaatcttaaacttatttttattatgattgtattgatacatgcacgaagtccctctgccctactccctattcaaggatattactcactgcacatcataaatctccatcatctgtcttaaagttttatgagtagatttcatctacattatattcaagttcatttattactgagctgtattactgtggagctctaacagtatttgtttcctgatttcaaactcaatgctacagagcactttgaatacatcacaccttataggaaagatagtaaatgtattaatcccattgaaaaattagttttgtacaatgtgctaaatagtattgcattggattacttttatatttaacacactccatcaaaacatcccataacataattttacaatctgcatgtgaatttaactgtgaaattcagtattgtgatattttgaataagtgaattctttctctgcaaatactatgttgataaaattacttgtatgttcccctgaaatggtttgtttcctgtttcttcattattaaaacataaatcaatcatatgtttacagata

SEQ ID NO: 137593 - DNA, 2068 bp, Homo sapiens
  Payload ID: 6938
  Gene Symbol: ERICH3
  Gene Name: glutamate-rich 3
  Uniprot ID: Q5RHP9
  ENST ID: ENST00000420661
  CDS Start-End: 180-1781
cctgatacacccatctcatcttgggaatgggctagccaaaggtaccagaaaactcaaaggtctttggctaaaatcctctgtatcctccagcagtaactttgccattaggactagaaatactcaaagtccaatgagtaggatttcctctcccctagatagtacttggatgggtgctttccatgcttgccaagggcaagaaggcagtgatgaagttcaggaactccataggcaattcacagagaatgaattcatatcaacttccaaacattaacagttacatgatgcctattcctcctccacttcccccaactgggaaaatcacaagagaaaatagatctgaaacatggagaaggagaagatttcgtccaaccactgctccaaatggcttagaacctcttttgacaaaggattcaagaaggattcataaaacatccttacatagtaatgcagctattacaatgatctatttggggaaaaatgtgcacctatcttctgataatcctgacttccgggatgaaattaaagtttatcagcagcactgtggtggggaaaacctttgtgtctacaaaggcaaactacttgaaaaagagacctttcagtttatttccaaaaggcatcatggtttccccttcagtctcacctttttcctgaatgggatgcaggtgaacaggttaagctcctgttgtgaatacaagcatcggaaaggttccaggcttggaggcaaacgaggctactttgggtttgtgtgtgttgagagatcatctccttgctacaagtgcattattgcaatgggccttgacaaaaaaccgtctttgccgaaatctaggaaagaaaagagcactgagaaaggagaggaactgaagaaggctgaggggaaagtgaggaaagagagagagtatgtgataccaaaaagaaatgagatcaaggagaacaaaacctctgtttcagccaaattttcagctcaagaaataaaaacagggctcaaagaagtggtaactgctgtggaggaaatgacaagtaaaggaaaaccaggacaagaagtcttggaagacgaccaggaaaatactttaaaatatgagtatgaagaagactttgaagtagatgaggagaaacaaggtgaaaaatctaatgaagaaggacaggctgatgttcaaatgaatggaataccgcagtcacctttggatgataaaaaagataatttagaccctgaaaaagagagtgaaacctcatcacagaaggcaccagatgcccgtgacaatgtgaaagatgagaatgatggatgctctgagagtgaactggaagaggataaacaagatatgaaaactgcttcatcaacctcatccagaagtcacccttattctagtgacagtgaggatgaatctgcagtgggggacagggaagcccacactgacagcagcacagatgaaagtgccagaaggtcatcttctcaggaactgagtgaaaatgataagccaagaaagtctcaccttccaattgaggaatccttagaaattgaaattgaagaccaagaaataacaaaagcagatgtggagaccaagccgatgccaatagacgaaagctttgagaatgttcttaaagaaggaacggagaaaggaacccaagagattgcagagggtttatctgagaagtccgggaaacatgtttctgcagaagaaaaggaaaaggataagagtaagctttgggaagaaagcactgctcaggtgaaggacaaaaaggcaggtctccctgggttggaggaaggtggtaagtatggccgttgagttgagctgccatcatcctcatgcatggaagctgattttggtcattgcactatgccaaagcttgggaaatactactgtgacaatgctttagggattcaagattttttgctgtgtctctctttgtcacataatcatacatgtattttcagtttgctgtttgccttctcttgcacttaaaaaattactcgataatttctatccagcctgtttcctattttcggtaaattccctcctatgggaattccatctcaggaatgaaataaagcacagtatgtgtctgaaggcaa

SEQ ID NO: 137594 - DNA, 738 bp, Homo sapiens
  Payload ID: 6938
  Gene Symbol: ERICH3
  Gene Name: glutamate-rich 3
  ENST ID: ENST00000479666
  CDS Start-End: 66-398
aaatactcaaagtccaatgagtaggatttcctctcccctagatagtacttggatgggtgctttccatgcttgccaagggcaagaaggcagtgatgaagttcaggaactccataggcaattcacagagaatgaattcatatcaacttccaaacattaacagttacatgatgcctattcctcctccacttcccccaactgggaaaatcacaagagaaaatagatctgaaacatggagaaggagaagatttcgtccaaccactgctccaaatggcttagaacctcttttgacaaagctcagttgtacttgcctgagaaatctgaaaagaaatgagaaggaaagtcataagcaactggtgaaggaaatcagaaagaagagctttagttatgcaggggcatgaggccttgttcctgttcttcaaatggaactgaattttcatggaaggttttgatacttacttgaggatagcagaaagggccgagaaaccttattaaagtttcatttgtctctggtcattatatctttgcaagatggattcaagaaggattcataaaacatccttacatagtaatgcagctattacaatgatctatttggggaaaaatgtgcacctatcttctgataatcctgacttccgggatgaaattaaagtttatcagcagcactgtggtggggaaaacctttgtgtctacaaaggcaaactacttgaaaaagagacctttcagtttatttccaaaagg

SEQ ID NO: 137595 - DNA, 946 bp, Homo sapiens
  Payload ID: 6939
  Gene Symbol: ERICH4
  Gene Name: glutamate-rich 4
  Uniprot ID: A6NGS2
  ENST ID: ENST00000378187
  CDS Start-End: 13-405
agctcagagacgatggaactgtggaggcagctgaatcaggctggactggtgcctccggggctgggcccacccccccaggccctgagggaggtctccccagtggaaatccctggtcagaccctcaggactgcaggggcagacactggaggtgcctgcgatagtctgctgtggatcagggaggagctggggaacctgcgccgagtggatgtccagctgctgggacagctgtgcagcctggggctggagatgggggcgctgcgggaggaactggtcaccatattggaggaggaggaggagagcagcaaggaagaggaggaggatcaagagccccagaggaagcaggaggaggaacacctggaggcctgcccagccccacatccacctgactttgagatgatgatctgaggctctgccagtggatttagattgacatacaaatgagatgcaaatgtatgtaaaggagaagggagatttgcaggtcaaagcagatgtggaatcaagtatacccctttagtaagtgctttctctgaaggtgcctgcaatgatatttaggcattggcctgtgagctatgggtgtgtttgcagatgacatgaggatgtgtttggaggtgatgtgggaggttgtagagaagttgcaggtgctttcgcagatgagcctcaggtgtgctgctgagatggggatctctgcaaatatgctggtgatgcatacagatgcgatttcagatcaacgctgtccagtatggtagccaccggacacacatggttatttagtgcttgaaacatggggactgcaaattgagatgtgctgtgagtgtaaaatacacaccaaatattaaaggcttagtatgatgaaaagaacataagacatctcaataatttttagattacttattgaaataataatattttgagcatatcagtattagtaaaaatattactaaaatta

SEQ ID NO: 137596 - DNA, 1761 bp, Homo sapiens
  Payload ID: 6940
  Gene Symbol: ERICH5
  Gene Name: glutamate-rich 5
  Uniprot ID: Q6P6B1
  ENST ID: ENST00000318528
  CDS Start-End: 360-1484
ccccctgacatcctccctatccctgctttaggggcttttcctctcttactgtgccataccctccaccgtctcccctcctgtctcctgggctctactcctccctgccctcctctgcgtcctggccctcccgctctcttccgctttgcgctcccaggctccttccacctcctgccagctcccttcctcctccaggtgcgcaccccctaccattagccccgctgcgcgcttgcgctctacgcccaagggagccgggctgcagagctggagaaacttccgcggctacgggtgcagttgccttcggttcccggttccgggccgacacccgcgcagggctgagacaggtgtctgcgctccccgcaatgggctgctccagcagcgccctcaacaaggccggcgacagcagcaggttccccagcgtaacttcaaatgagcatttttcaactgcagaagaaagtgagtcctgctttgcccaaccaaagccacatgcactgggaagagaatctactgttgatggcaatgtacaaagggaaagccgtcctcccttacaaaagctcaaggtttcagcagagcctacagctaatggtgttaaacccctccaagaacagcccctggccaaggacgtagcccctggaagggatgccacagaccaatcagggtccacagaaaagactcagcctggagagggactggaggaatctgggccgcctcaaccaggtggcaaagaggatgccccagcagcagaaggaaagaagaaagatgcaggagcagggacagaggccgagtctctaaaaggaaatgctgaagctcagcctttaggaccagaagccaagggtcagcctttgcaggcagcagtagagaaggactctctcagagcagtggaggtcactgagaatccacaaactgctgcagagatgaagcctctaggaacaactgagaacgttctgactctgcaaatagctggagagctacaacctcagggcacagtgggaaaggatgagcaggccccgcttctagaaacaatttccaaagagaatgaatctccagaaatattggaaggaagtcagtttgtggaaacagctgaagagcagcaacttcaggcaacattgggaaaagaggagcagccccagcttctagaaagaattcccaaagagaatgtaacaccagaagtattggacagaagtcagcttgtggaaaagcctgttatgaatgatccattccataaaactcctgaaggtccaggaaacatggagcagattcaacctgaaggaatagttggaagcatggagcatccagcacgaaatgtagaggcaggagcatatgtggaaatgatcaggaacatccatactaatgaagaggaccaacgcattgaaggtgagacaggggaaaaggtggaaacagacatggagaatgagaaagtgagtgaaggggctgaaaccaaagaagaagaaacaggagaagtggtggacctttcagcagccacatagatagaagagtgaaccgacacagtgtgttatcatagaggagacaaaaatggtagtgaagcttgtggttatgtatcttatctttctacatttacatgttttctgtaaggagtgtggttatagagagactgttggaaccatgagaaggatgtttctgtgttcttgattatattgttctgcaaaactgctaagccatgaacagttttcttagctacttagaatggttatacatttaaaagtataaaaaccaaagccaataaaaatgatgtgattatttaag

SEQ ID NO: 137597 - DNA, 596 bp, Homo sapiens
  Payload ID: 6940
  Gene Symbol: ERICH5
  Gene Name: glutamate-rich 5
  Uniprot ID: Q6P6B1
  ENST ID: ENST00000545282
  CDS Start-End: 149-319
agccccgctgcgcgcttgcgctctacgcccaagggagccgggctgcagagctggagaaacttccgcggctacgggtgcagttgccttcggttcccggttccgggccgacacccgcgcagggctgagacaggtgtctgcgctccccgcaatgggctgctccagcagcgccctcaacaaggccggcgacagcagcaggttccccagcggtgagacaggggaaaaggtggaaacagacatggagaatgagaaagtgagtgaaggggctgaaaccaaagaagaagaaacaggagaagtggtggacctttcagcagccacatagatagaagagtgaaccgacacagtgtgttatcatagaggagacaaaaatggtagtgaagcttgtggttatgtatcttatctttctacatttacatgttttctgtaaggagtgtggttatagagagactgttggaaccatgagaaggatgtttctgtgttcttgattatattgttctgcaaaactgctaagccatgaacagttttcttagctacttagaatggttatacatttaaaagtataaaaaccaaagccaataaaaatgatgtgattatttaag

SEQ ID NO: 137598 - DNA, 2052 bp, Homo sapiens
  Payload ID: 6941
  Gene Symbol: ERICH6
  Gene Name: glutamate-rich 6
  Uniprot ID: Q7L0X2
  ENST ID: ENST00000295910
  CDS Start-End: 54-2045
gccgaccggggccgcggccaaagagctggctgtaatcccgcctcccgccagccatggcccacttgcgctcgcctagcggcttcggagacccggggaagaaggaccagaaggagtcagaggaggagttagaggaggaggaggaggaggaagaggtggaggaggaggaggaagaggtggaggaggaggaggaagaggtggaggaggaggaggaggaggtggtggaggaggagttggtgggggaagagcaggagttggaggcccctgagacgttcagcgaagagtacctctggaaggtcacggacatcggtgactacgacgacgacttcccagacgtgcgcccccgcttagccagcatcgtcagccctagcctgacctctacgttcgtgcccagccagagcgcgaccagcactgaaacgccgagcgcaagcccaccctccagcacctcctcgcataaaagtttccctaaaatatttcagacatttaggaaagacatgtctgaaatgagtatagatagaaatattcatcgcaatttgtctccaggaattccagtatcagtacaaacagaagaaagttggctccaagatttgtctgataaagtgcaatcgaggaagaaagcctctaaagagaaagctgaacctgaatgtctggcatctaagttaagagaaaaatgggtaattaatccagaagagtcgaaactaaatattttatatgagctggagtttaaggaagacttcataacactgttcgagccttctctaagaacgttacccagcatcggaccaccatccattctggcatacaaagaagagagctccaatttaggcattaacttcaaggatgaagaggaggagacatcacccaaatgtgaattttgtggcagcgatctaagagcatttttttctaatgtggatgtttcctctgaaccaaaagggcatgcctcctgttgtattgctttccaaaatctgattgactatatctatgaggagcaaataaaaaccaaaccccctaaagctgaattaattgctattgaccctcatgcagcccatggtagtgaggtcgacagactcaaggcaaaagaaaaagccctgcaaaggaaacaggagcaacgaatggccagacattttgcaataatatcaagggaacagactcatttctctgaagatgattcaaagcgcttaaaaacaatttcttatcaactttctgtggatattccagaaaaacagataattgatgacattgtatttgattttcaactaagaaacagtaacatgtctatcatttgttgtgattctcggatagcatgtggaaaggttgtcaggaatgagctcttagagaagcactacaaacatgggagcaagtttctgacttcatttccagatgggacaacacaaatattctatccatctggaaacctagccatcattcgagtgcccaacaaggtaaatggttttacttgtatagtccaagaagatatgcccactaaccctgctatcctagcagtgctggattcctctggcagaagttcctgctatcatcccaatggaaatgtctgggtatacatcaatatcttgggaggtcaatattcagatcaagccggcaacagaataagggcttggaattggtcaaattccatcacttcctcaccctttgtttcatttaaacctgtctttctggctttgaaccgttatattggagtccgcatcttagaacaagacaagatttctataacttttctagcaatgggccaacaggcaagaatcagtgttggaaccaaagtgaagctaccaaaccctgaggagattccaatcctccgatacgtaagtggagatgaccttcttctgctggccagtttaataaagatccgtcgcctgtttcataaacttgaaggatgtgtgaattttccctcaagccaggtttgggaaaaattaaagcaaccttcctacctttcttcactttctctaaaactaattgccctttgtcacagttctggtataaagcaagatataatgaagacaataagaaatataataaatgaagaaatttaactaagaa

SEQ ID NO: 137599 - DNA, 479 bp, Homo sapiens
  Payload ID: 6941
  Gene Symbol: ERICH6
  Gene Name: glutamate-rich 6
  ENST ID: ENST00000498386
  CDS Start-End: 74-479
agaggctcgcgctcgcgagagccgaccggggccgcggccaaagagctggctgtaatcccgcctcccgccagccatggcccacttgcgctcgcctagcggcttcggagacccggggaagaaggaccagaaggagtcagaggaggagttagaggaggaggaggaggaggaagaggtggaggaggaggaggaagaggtcacggacatcggtgactacgacgacgacttcccagacgtgcgcccccgcttagccagcatcgtcagccctagcctgacctctacgttcgtgcccagccagagcgcgaccagcactgaaacgccgagcgcaagcccaccctccagcacctcctcgcataaaagtttccctaaaatatttcagacatttaggaaagacatgtctgaaatgagtatagatagaaatattcatcgcaatttgtctccaggaattccagtatcagtacaaacagaagaaagttggctcc

SEQ ID NO: 137600 - DNA, 526 bp, Homo sapiens
  Payload ID: 6941
  Gene Symbol: ERICH6
  Gene Name: glutamate-rich 6
  ENST ID: ENST00000474463
  CDS Start-End: 35-526
aaagagctggctgtaatcccgcctcccgccagccatggcccacttgcgctcgcctagcggcttcggagacccggggaagaaggaccagaaggagtcagaggaggagttagaggaggaggaggaggaggaagaggtggaggaggaggaggaagaggtggaggaggaggaggaagaggtggaggaggaggaggaggaggtcacggacatcggtgactacgacgacgacttcccagacgtgcgcccccgcttagccagcatcgtcagccctagcctgacctctacgttcgtgcccagccagagcgcgaccagcactgaaacgccgagcgcaagcccaccctccagcacctcctcgcataaaagtttccctaaaatatttcagacatttaggaaagacatgtctgaaatgagtatagatagaaatattcatcgcaatttgtctccaggaattccagtatcagtacaaacagaagaaagttggctccaagatttgtctgataaagtgcaatcgaggaagaaagcctctaaa

SEQ ID NO: 137601 - DNA, 1755 bp, Homo sapiens
  Payload ID: 6941
  Gene Symbol: ERICH6
  Gene Name: glutamate-rich 6
  Uniprot ID: Q7L0X2
  ENST ID: ENST00000491361
  CDS Start-End: 195-1748
cgcgagagccgaccggggccgcggccaaagagctggctgtaatcccgcctcccgccagccatggcccacttgcgctcgcctagcggcttcggagacccggggaagaaggaccagaaggagtcagaggaggagttagaggaggaggaggaggaggaagaggtttccctaaaatatttcagacatttaggaaagacatgtctgaaatgagtatagatagaaatattcatcgcaatttgtctccaggaattccagtatcagtacaaacagaagaaagttggctccaagatttgtctgataaagtgcaatcgaggaagaaagcctctaaagagaaagctgaacctgaatgtctggcatctaagttaagagaaaaatgggtaattaatccagaagagtcgaaactaaatattttatatgagctggagtttaaggaagacttcataacactgttcgagccttctctaagaacgttacccagcatcggaccaccatccattctggcatacaaagaagagagctccaatttaggcattaacttcaaggatgaagaggaggagacatcacccaaatgtgaattttgtggcagcgatctaagagcatttttttctaatgtggatgtttcctctgaaccaaaagggcatgcctcctgttgtattgctttccaaaatctgattgactatatctatgaggagcaaataaaaaccaaaccccctaaagctgaattaattgctattgaccctcatgcagcccatggtagtgaggtcgacagactcaaggcaaaagaaaaagccctgcaaaggaaacaggagcaacgaatggccagacattttgcaataatatcaagggaacagactcatttctctgaagatgattcaaagcgcttaaaaacaatttcttatcaactttctgtggatattccagaaaaacagataattgatgacattgtatttgattttcaactaagaaacagtaacatgtctatcatttgttgtgattctcggatagcatgtggaaaggttgtcaggaatgagctcttagagaagcactacaaacatgggagcaagtttctgacttcatttccagatgggacaacacaaatattctatccatctggaaacctagccatcattcgagtgcccaacaaggtaaatggttttacttgtatagtccaagaagatatgcccactaaccctgctatcctagcagtgctggattcctctggcagaagttcctgctatcatcccaatggaaatgtctgggtatacatcaatatcttgggaggtcaatattcagatcaagccggcaacagaataagggcttggaattggtcaaattccatcacttcctcaccctttgtttcatttaaacctgtctttctggctttgaaccgttatattggagtccgcatcttagaacaagacaagatttctataacttttctagcaatgggccaacaggcaagaatcagtgttggaaccaaagtgaagctaccaaaccctgaggagattccaatcctccgatacgtaagtggagatgaccttcttctgctggccagtttaataaagatccgtcgcctgtttcataaacttgaaggatgtgtgaattttccctcaagccaggtttgggaaaaattaaagcaaccttcctacctttcttcactttctctaaaactaattgccctttgtcacagttctggtataaagcaagatataatgaagacaataagaaatataataaatgaagaaatttaactaagaa

SEQ ID NO: 137602 - DNA, 2421 bp, Homo sapiens
  Payload ID: 6942
  Gene Symbol: ERICH6B
  Gene Name: glutamate-rich 6B
  Uniprot ID: Q5W0A0
  ENST ID: ENST00000298738
  CDS Start-End: 166-2256
cacaaacgccggggcctgagatcgcggtggatgcacgcgcgggagcctggcttggctgttattgttgaaaactctcttggcttggactcagtttaccccctgacattgataataaagtgacgttggctgctgcagaaggagttcaccacctacgacttccccagcatgtctgctgaaaataatcagttatcaggagcatcacctcctcaccctcccacaactccccaatattccacacagaacttgccttcagagaaagaggatactgaagtagaactagatgaggaaagtctacaggatgaatctccattttctccagagggagagtctctggaggacaaagagtatctggaggaggaagaggatctggaagaggaagagtatctggggaaagaagaatacttgaaggaggaagagtatctggggaaggaagagcatctggaggaggaagagtatctggagaaggcagggtatctggaggaggaagagtatattgaagaggaagagtatctggggaaggaagggtatctggaggaggaagagtacctggggaaggaagagcatctggaggaggaagagtatctggggaaggaagggtatctggagaaggaagattatattgaggaggtagattatctggggaagaaagcgtatctggaggaggaggagtatctggggaagaaatcatatctagaagaggaaaaggctctggagaaggaagagaatctggaggaggaagaagctctggagaaggaagagaatctggatggaaaagaaaatctgtataaaaagtatctgaaagaacccaaggcaagttattcatcacaaaccatgcttcttcgtgatgcaaggagtccagacgctggcccctctcaggtgaccaccttcttgactgtcccgttgactttcgctaccccttctcctgtctctgaatctgccacagagtcttctgagttgcttctgacattgtacaggaggagccaggccagtcagacagactggtgctacgacagaactgccgtaaaatctttaaaatcgaaatcagaaacagagcaagaaaccaccacgaagctggctccggaagagcatgttaacactaaagtacagcaaaaaaaggaagaaaatgtcctggagtttgcttctaaagagaacttttgggatggtataacagatgagtccattgacaagctggaagtggaagatttagatgaaaactttttgaacagctcctatcagacagtatttaaaacaataatcaaagaaatggctgctcacaatgaactggaagaggattttgacattcccctaactaagctactggaaagtgaaaacagatggaaactggtaattatgctgaagaaaaattatgaaaagttcaaggaaacaatcttacggattaagaggagacgtgaagctcaaaagttaacagagatgaccagtttcacatttcatttaatgagcaaaccaacacctgagaagcctgagacagaagaaatccaaaagcctcaacgtgttgttcatcataggaagaaattagaacgagataaggaatggatacagaagaagacagtggtgcatcaaggtgatggaaaattaattctctaccccaacaagaatgtctatcaaattctctttcctgatgggacaggccagatacattatccatcaggaaacctggctatgctcatcttatatgcgaaaatgaaaaagttcacatacatcattctggaagacagtctagaagggaggatccgggcccttatcaacaactcaggcaatgctaccttctatgatgaaaatagtgatatctggttgaacctgagctccaacctgggctactacttccccaaagacaaacgccagaaggcctggaactggtggaatctgaacatccatgtccacgcaccccctgtccagcccatctccttgaaaatcaatgagtacatccaggtacaaataaggagccaggataagatcatcttctgcttcacctatgaacagaagcagatttgtttaaacctgggcaccaggtacaagtttgtgatcccagaggtgctgagcgaaatgaagaagaaaaccatcctggaggcagaacccggcccaacagcccagaagatccgggtccttctggggaaaatgaataggctcctgaattacgcgaccacccctgatctggaaaacttcatagaggccgtcagtatatcactgatggacaacaagtacctgaagaagatgctctctaaactctggttttaaggcggggcttatctggcatccaccaaatgccttaggaagttggagaccttgggagctccagggaaaaaaaacccaaagacctgttgaccttttatgagagttggtttgtaatttgggacctgtcgtggctccttgatttgaagtaaacatttttggcagaagggc

SEQ ID NO: 137603 - DNA, 5571 bp, Homo sapiens
  Payload ID: 6943
  Gene Symbol: GRWD1
  Gene Name: glutamate-rich WD repeat containing 1
  Uniprot ID: Q9BQ67
  ENST ID: ENST00000253237
  CDS Start-End: 234-1574
actaccgcgaggaacagcgcccaaagtcacgcgaagatgcagtttctccgtatccgcaggcttctttcgctggcgccattacctgagttctcctccagcgtttccgcaccctctccgattagcggtcccaggagtttccaaggtaaccgcgcagtagggcggatctcattaggcggaaagcgaaacccggaagtgacgctcttaccgggtgtcagcagcgagagggttcgaagatggcggcgcgcaagggtcggcggcgcacgtgtgaaaccggggaacccatggaagccgagtccggcgacacaagttccgagggcccggcccaggtctacctgcccggccgggggccgccgctacgcgaaggggaggagctggtcatggacgaggaggcctatgtgctctaccaccgagcgcagactggcgccccctgtctcagctttgacatagtccgggatcacctgggagacaaccggacagagcttcctcttacactttacttgtgtgctgggacccaggctgagagcgcccagagcaacagactgatgatgcttcggatgcacaatctgcatgggacaaagcccccaccctcagagggcagtgatgaagaagaagaggaggaagatgaagaggatgaagaagagcggaaacctcagctggagctggccatggtgccccactatggtggcatcaaccgagttcgggtgtcatggctgggtgaagagcctgtggctggggtgtggtcagagaagggccaggtggaggtgtttgcgctgcggcggcttctgcaggtggtggaggagccccaggccctggcagccttcctccgggatgagcaggcccaaatgaagcccatcttctccttcgctggacacatgggcgagggctttgcccttgactggtccccccgggtgaccggtcgcctgctgaccggtgactgtcaaaagaacatccacctctggacacctacggacggcggctcctggcacgtggaccagcggccattcgtgggccacacacgctctgtggaggacctgcagtggtcaccgactgagaacacggtgtttgcctcctgctcagctgacgcctccatccgcatctgggacatccgggcagcccccagcaaggcctgcatgctcaccacagccaccgcccatgatggggacgtcaatgtcatcagctggagccgccgggagcccttcctgctcagtggcggggatgatggggccctcaagatctgggaccttcggcagttcaagtctggttccccagtggccaccttcaagcagcacgtggcccccgtgacctccgtcgagtggcacccccaggacagcggggtctttgcagcctcgggtgcagaccaccagatcacacagtgggacctggcagtggagcgggaccctgaggcgggcgacgtggaggccgaccccggactggccgacctcccgcagcagctgctgttcgtgcaccagggcgagaccgagctgaaggagctgcactggcacccgcagtgcccagggctcctggtcagcacggcgctgtcaggcttcaccatcttccgcaccatcagcgtctgaggcgtcccactggctctgatcttgcttcctgcttggaaactgaagtcgaattgggctcccctggaaggggttcattcaggtctgttgactgagactggccggcctgtgggctgccgtgatggattctgtttgacgtattgttctctagaaggcctggctctgatccagtgacccctctcaccaaagaactcggtttaaccagggctctgtaagaccactcccacccagagacttgtgtggcctggtgtggcctgtgtgtcggattccttcctgtcagctgtgacccatttgacctgtgtccccagaacccagttttttgtttgtttgtttgagacggagtcttggtctgtcgcccaggctggagtgcagtagcacgatcttggctcactgcaacctccgcctcctgggttaaagtgattctctcagctcagtctcccaggtagctgggattacaggcatgtgccaccacaccccgttaatttttgtatttttagtagagacggggtttcaccatgttggccaggctggtctcaaattcttgatctcaagtgatctgtccgccccggcctcccagagtgctgggttgggattacaggcgtgagccaccgcgtccggctcaggacccagttttggctgctggttcccagcaggggactcgggggatatacagtggctgcaccaaattggaggtgtgggttcctccaacacaatttgcttctgcccgttgtcttcctgccagctgggtttggccaggatttctccgtgtgggggctacatgcgaccctctcccctcctccctgactttagaggctggtgctgtgtcgggaggaaggtcagggctcctgagcagcaataaaggaccaggaagaggcctgaggtgtatttgagactctggtcctttggccacagccctatgaggaaacggggtgtggggggagtttgggggtggggaggaatttggcaccagctgcccccaggccgctaggctgggggaggccactgggagtccagtgcaacccaaccttccgcccactgggtgccgccgcgttctgccttctctaagtgtccttccatctggaactcactctggcttagtgaaaggggcctcatccctgacccccaccagcttatgaaggcttcatctcagggaactctggaccccccatttctccctccgtccatctcccctttatcacgtttctttctttcttctctgtgtccccctctttcagagtctcccgtcccccactgccagtctccctgccccctagtcgctgtctcgctcctccgccgctgtctcctgtccagcctgcctgggctgtggcccagccgctctgcctggctggcctccctggctccccctctgcggctctgagctagccccacccccggcccccctccatccagcctctgatccatctgtggactccgaggtcgggtgcccgtcacacggcccctgggaccaaggacagactacagcccctcagcacccacagaggcttcccctcagccctagccgaggagcccccagcggagggcatgggggtgggccgccccaacaggtacgtgcctccatgcaaggcaccgctgagccatcccctcctgctctgctgcgtcgcccccatccacccctgccccagcatccctgtcctcagcttgtccccttcaagaaggccttgtcttcccatcagtgacaggctcagcgccaggagaatccacccccaggttcagtgcctccaactctcaccccatccccattttatgcattttctcactggcttccatcctttcagagaaaccctctcagtctgtctgtctctgtctctgtctctctcccccatctctgtctctcccatctctctctgcctctctctgtcttcacaatttcatctccccatgtcgccatttcttaaaacatttcttttctccttttcgttttcccaattgccctgtccgcctctatcttctctgtccccctccatctaggtctctgtccccccctctctctgggtctctgtccccctctgtctctgagtctctatcctctcaaggtctctgttcccctctctctgggtctctgtcctctctcaaggtctctgtccctttctctctggatcaatgtccctttcctgctgccctctctgggtctctgtccccctctctctcagggtccctgtcctgcttggtccctgtactttttcttggggcaccctctcaacacccctcctcctgcctatctctgcatctctttgtctttctgtagtctctgctttccaacctgctgtccagcccccaccagtaggtggggagtggtggggaacacccctggtttcggaagagtgagagtgttgatttgggagggtgagggtggggcctgggggcggggcttcttggcctcagattagacagtgactttgacacgaagttgaagcaccttaagccctgtatctcctttatatggaaacattaagctgctctcgcaggtcaggtggaggatccctttccctcccgccctgcttttgctaggggaggggggtgccctgagcctgagtcgcagccagcctgggagctgggccatgttggccgcagatggccccctggtgaaggttcccgttggctttgggaagtagacaacgggtctgcctcacggggctgaggtgggactggaggatttcgagggcagaactctgggaaggaaagaaaggcttaggacccaaccagcattccccctggcactgcgggggcctggccagctcatggcgttccctgagcctgttccccaactgtgaaagggggtgatgatcttcacctcccggcatcctgagcggccaaggtgagcagtggggtctgagagtccagtgggggctgtgggcatgtcgggagctcatcacgaggcctcgtacataccaggtgtgtttgaaaccagagtgctcttgagaagactgtggtttgtcactcgggccgtggctcccaggaggcctgggtgggaggctagcttttgccactcctctccccactggctgagagacctgcgacaagggactaacctcagccccagttggcttttctgtgaaaagccaggtcccttcatcaaagggctttggtgagagatgggcaagtgggggtgagaggcccaggctggggcctggggagcacaggtcagtgtcagtgcccacctgcccccccagcccacgggggtggttcctgagggtggagtcagtgctgagtggggatccccaggctggggagggctgcaggtgtagatgctgcatcctgatgttgacctccaggccgcccccttgggcaacgagcctatttcccctttttgggagaacagtctctaacatgcagggttgtcaggggtgagatagagtcaaggttggggtacactgtgggcactggacacagccaggctggtcccctcacctcagccttgcctctgtcaagtgggcctaatgaaccctcgcgaatggccaggctgcctgcgtggttgtgggaagcaggtgcagggctttgggagacccagttggtgccaaacttgacattgtctcatggtcttctttccaaatggagtgtgccaggccctgccaagaagcccctgaggatccccaggttccagcacaaattatttaacccctggaatggtttgtcctgatccagccagttcctgggaagttccccaccacagggccaagcgtttggtaacgttgcagtgaaccctgaaggcaatgaggggtgcgggtccatgcccagccctttcctttggtccaccctgacaggctgctgcgattccctccatttcttttcttcctttattttttatttttaattatttatttattttttagagacagggttttgctgtcttccccaggctggttctcaaacccctggcctcacgcattcctcctgagttggactcccaaagtgctaggattacaggtgtgagccaccgcacctgccctcttttttttttttttttctttaagagataggg

SEQ ID NO: 137604 - DNA, 881 bp, Homo sapiens
  Payload ID: 6943
  Gene Symbol: GRWD1
  Gene Name: glutamate-rich WD repeat containing 1
  ENST ID: ENST00000598711
  CDS Start-End: 197-881
gctggcgccattacctgagttctcctccagcgtttccgcaccctctccgattagcggtcccaggagtttccaaggcgccccctgtctcagctttgacatagtccgggatcacctgggagacaaccggacagagcttcctcttacactttacttgtgtgctgggacccaggctgagagcgcccagagcaacagactgatgatgcttcggatgcacaatctgcatgggacaaagcccccaccctcagagggcagtgatgaagaagaagaggaggaagatgaagaggatgaagaagagcggaaacctcagctggagctggccatggtgccccactatggtggcatcaaccgagttcgggtgtcatggctgggtgaagagcctgtggctggggtgtggtcagagaagggccaggtggaggtgtttgcgctgcggcggcttctgcaggtggtggaggagccccaggccctggcagccttcctccgggatgagcaggcccaaatgaagcccatcttctccttcgctggacacatgggcgagggctttgcccttgactggtccccccgggtgaccggtcgcctgctgaccggtgactgtcaaaagaacatccacctctggacacctacggacggcggctcctggcacgtggaccagcggccattcgtgggccacacacgctctgtggaggacctgcagtggtcaccgactgagaacacggtgtttgcctcctgctcagctgacgcctccatccgcatctgggacatccgggcagcccccagcaaggcctgcatgctcaccacagccaccgcccatgatggggacgtcaatgtcatcagctggagccgccgggagcccttcctgctcagtggcggggatgatggggccc

SEQ ID NO: 137605 - DNA, 3984 bp, Homo sapiens
  Payload ID: 6944
  Gene Symbol: GPT2
  Gene Name: glutamic pyruvate transaminase (alanine aminotransferase) 2
  Uniprot ID: Q8TD30
  ENST ID: ENST00000340124
  CDS Start-End: 113-1684
gcggggatgcggctgtgggcgccggggccgggtagctgctccaggcgcgcgagctaaccgagtgcggcgagggcctaccaggggcgacagggtttctctccgcaagcgcgcgatgcagcgggcggcggcgctggtccggcggggctgtggtccccggacccccagctcctggggccgcagccagagcagcgcggccgccgaggcctcggcggtgctcaaggtgcggcccgagcgcagccggcgcgagcgcatcctcacgctggagtccatgaacccgcaggtgaaggcggtggagtacgccgtgcggggacccatcgtgctcaaggccggcgagatcgagctcgagctgcagcggggtatcaaaaagccattcacagaggtcatccgagccaacatcggggacgcccaggctatggggcagcagccaatcaccttcctccggcaggtgatggcactatgcacctacccaaacctgctggacagccccagcttcccagaagatgctaagaaacgtgcccggcggatcctgcaggcttgtggcgggaacagcctggggtcctacagtgctagccagggtgtcaactgcatccgtgaagatgtggctgcctacatcaccaggagggatggcggtgtgcctgcggaccccgacaacatctacctgaccacgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagatgtgatccactttgcctgggaagagaagctctttctcctggctgatgaggtgtaccaggacaacgtgtactctccagattgcagattccactccttcaagaaggtgctgtacgagatggggcccgagtactccagcaacgtggagctcgcctccttccactccacctccaagggctacatgggcgagtgtggttacagaggaggctacatggaggtgatcaacctgcaccctgagatcaagggccagctggtgaagctgctgtcggtgcgcctgtgccccccagtgtctgggcaggccgccatggacattgtcgtgaaccccccggtggcaggagaggagtcctttgagcaattcagccgagagaaggagtcggtcctgggtaatctggccaaaaaagcaaagctgacggaagacctgtttaaccaagtcccaggaattcactgcaaccccttgcagggggccatgtacgccttccctcggatcttcattcctgccaaagctgtggaggctgctcaggcccatcaaatggctccagacatgttctactgcatgaagctcctggaggagactggcatctgtgtcgtgcccggcagtggctttgggcagagggaaggcacttaccacttcaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactctgcctcgggcctcgcagaggccgctggtcacttcgtcatcattttgcccctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgatctgtgaaataaagcccttagcggtgtgaagcatccggtcctttgaacagaagggcctggaaggcccctggggctgagaaagggtccgcccggtggcctggaggcaggcgccgggagcgcagtagcacgtggactgggcaggatgttgcactagcttggggtagatgctgggggctgcggccacggtcagagggccccactgtgaggcgtgggtgtgagccaggctgcaggaggaactgggcctccgcttcccagcaacgcagccaggcctgagaattctgtgcgcccggcgggctttgggaatgaggggttcccttgaacatgcgtaggctggaaccccgtctgagaggtctccctgaatttcagtgacacatagtgcagcccggcagtgtcccacttccgtggagagagccgctggaatggtgtggacccatcccgcgggtgaccggtgcctgttctcccctgaccgagcctgtgagcacatcgccccctgctggcgacagcggggaaatgagggctgaaaatatcctccccacaagggcaatccccgggacctgccgagcagccaaggccctgtcctttcttgaatggtggcgagctgaatctggtcggtttcctagcttttaggtggtaaaagtgcctggcagcttggctgccgtggaggagtcagtcgtggttggaggttcattgccgtgctttcatgcagagtgttttgccttcatgttagcttccggctcccctcccaggctgcagactctgacctgtggcatcaggcttctcccagtacaggagggtgccatcccccagcatgcggcttctctgccattagcagccctgggcgggccgaccacactcgaggctgcggtgctacgggcttagccctcgcctccctcactgggagcttccccatcctccctgccttccccagtgggaagttagggaagctcaggagcctgggaccccgcatgtcccaaaatgggattggagaagctggagagaaagcagaagaggccgaggagtgaggcagcagcctctatgctgtgatttccacaccgggtccgtgcagaggaaacagaaactcccaactgtccttacccaccgacatcacagcccctatgaagaaagtagccacaatctcaaataacaaaagggaatgttctaaaactttttcttccttaaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggttagtatttatagtcctaacaagtccagtaattttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgttttcccgtctaggttctcacaggtatctcctgacagaggtacttaacaatggctctgctggaaatttctataaataaaatgtccaaaatggtgactgcgttt

SEQ ID NO: 137606 - DNA, 4228 bp, Homo sapiens
  Payload ID: 6944
  Gene Symbol: GPT2
  Gene Name: glutamic pyruvate transaminase (alanine aminotransferase) 2
  Uniprot ID: Q8TD30
  ENST ID: ENST00000440783
  CDS Start-End: 666-1937
gcgcagccggcgcgagcgcatcctcacgctggagtccatgaacccgcaggtgaaggcggtggagtacgccgtgcggggacccatcgtgctcaaggccggcgagatcgagctcgagctgcagcgggtgagcgcgcgctgggccccggggaggctggggccgctgagcaagggaaaaaccgcagcagccccagctggggtccttcccacgacgtccacccccatggccagctcctcagtcagccaagcctggctaaaacgagagaatgccccctcccgcccgttcacttactggtgcccagcaccgggcactcagtgaggccttgcaatacggttcacttgttgaattgaattcgtcaattgttgagcgggccgtgctgccaggcaccgcacgttgtgtgtctgccctactctcgtggaaccaaggtccagtggagagaggaacataagcgaatgaagaaagaagcaatagagtctcagtgataagttcttggaaaaaaggtctttgccaatcctgattcccggaagagagtcggcagaattccttcctttaggcccctctggagccttggccgaccagccacttctgtggtctggggacagtcaccgagggtatcaaaaagccattcacagaggtcatccgagccaacatcggggacgcccaggctatggggcagcagccaatcaccttcctccggcaggtgatggcactatgcacctacccaaacctgctggacagccccagcttcccagaagatgctaagaaacgtgcccggcggatcctgcaggcttgtggcgggaacagcctggggtcctacagtgctagccagggtgtcaactgcatccgtgaagatgtggctgcctacatcaccaggagggatggcggtgtgcctgcggaccccgacaacatctacctgaccacgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagatgtgatccactttgcctgggaagagaagctctttctcctggctgatgaggtgtaccaggacaacgtgtactctccagattgcagattccactccttcaagaaggtgctgtacgagatggggcccgagtactccagcaacgtggagctcgcctccttccactccacctccaagggctacatgggcgagtgtggttacagaggaggctacatggaggtgatcaacctgcaccctgagatcaagggccagctggtgaagctgctgtcggtgcgcctgtgccccccagtgtctgggcaggccgccatggacattgtcgtgaaccccccggtggcaggagaggagtcctttgagcaattcagccgagagaaggagtcggtcctgggtaatctggccaaaaaagcaaagctgacggaagacctgtttaaccaagtcccaggaattcactgcaaccccttgcagggggccatgtacgccttccctcggatcttcattcctgccaaagctgtggaggctgctcaggcccatcaaatggctccagacatgttctactgcatgaagctcctggaggagactggcatctgtgtcgtgcccggcagtggctttgggcagagggaaggcacttaccacttcaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactctgcctcgggcctcgcagaggccgctggtcacttcgtcatcattttgcccctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgatctgtgaaataaagcccttagcggtgtgaagcatccggtcctttgaacagaagggcctggaaggcccctggggctgagaaagggtccgcccggtggcctggaggcaggcgccgggagcgcagtagcacgtggactgggcaggatgttgcactagcttggggtagatgctgggggctgcggccacggtcagagggccccactgtgaggcgtgggtgtgagccaggctgcaggaggaactgggcctccgcttcccagcaacgcagccaggcctgagaattctgtgcgcccggcgggctttgggaatgaggggttcccttgaacatgcgtaggctggaaccccgtctgagaggtctccctgaatttcagtgacacatagtgcagcccggcagtgtcccacttccgtggagagagccgctggaatggtgtggacccatcccgcgggtgaccggtgcctgttctcccctgaccgagcctgtgagcacatcgccccctgctggcgacagcggggaaatgagggctgaaaatatcctccccacaagggcaatccccgggacctgccgagcagccaaggccctgtcctttcttgaatggtggcgagctgaatctggtcggtttcctagcttttaggtggtaaaagtgcctggcagcttggctgccgtggaggagtcagtcgtggttggaggttcattgccgtgctttcatgcagagtgttttgccttcatgttagcttccggctcccctcccaggctgcagactctgacctgtggcatcaggcttctcccagtacaggagggtgccatcccccagcatgcggcttctctgccattagcagccctgggcgggccgaccacactcgaggctgcggtgctacgggcttagccctcgcctccctcactgggagcttccccatcctccctgccttccccagtgggaagttagggaagctcaggagcctgggaccccgcatgtcccaaaatgggattggagaagctggagagaaagcagaagaggccgaggagtgaggcagcagcctctatgctgtgatttccacaccgggtccgtgcagaggaaacagaaactcccaactgtccttacccaccgacatcacagcccctatgaagaaagtagccacaatctcaaataacaaaagggaatgttctaaaactttttcttccttaaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggttagtatttatagtcctaacaagtccagtaattttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgttttcccgtctaggttctcacaggtatctcctgacagaggtacttaacaatggctctgctggaaatttctataaataaaatgtccaaaatggtg

SEQ ID NO: 137607 - DNA, 554 bp, Homo sapiens
  Payload ID: 6944
  Gene Symbol: GPT2
  Gene Name: glutamic pyruvate transaminase (alanine aminotransferase) 2
  ENST ID: ENST00000562132
  CDS Start-End: 22-554
gtttctctccgcaagcgcgcgatgcagcggggtatcaaaaagccattcacagaggtcatccgagccaacatcggggacgcccaggctatggggcagcagccaatcaccttcctccggcaggtgatggcactatgcacctacccaaacctgctggacagccccagcttcccagaagatgctaagaaacgtgcccggcggatcctgcaggcttgtggcgggaacagcctggggtcctacagtgctagccagggtgtcaactgcatccgtgaagatgtggctgcctacatcaccaggagggatggcggtgtgcctgcggaccccgacaacatctacctgaccacgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaa

SEQ ID NO: 137608 - DNA, 1947 bp, Homo sapiens
  Payload ID: 6945
  Gene Symbol: GOT1
  Gene Name: glutamic-oxaloacetic transaminase 1, soluble
  Uniprot ID: P17174
  ENST ID: ENST00000370508
  CDS Start-End: 29-1270
gaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaaga

SEQ ID NO: 137609 - DNA, 1378 bp, Homo sapiens
  Payload ID: 6946
  Gene Symbol: GOT1L1
  Gene Name: glutamic-oxaloacetic transaminase 1-like 1
  Uniprot ID: Q8NHS2
  ENST ID: ENST00000307599
  CDS Start-End: 101-1366
gaggcaggactgcccggcccagccttggaggaagacttctgggcagaagcggaacacaggagcagagacacatagtcttggctccagtttcgtttcagttatgcccaccctttcagtgttcatggatgtgcccctcgcccacaagctagagggcagcttgttaaagacctacaaacaagatgattacccgaacaagatattcttagcctatagagtctgcatgacaaatgaaggccatccctgggtttctctcgtggtgcagaagactcgactacagatttcacaggatccctccctgaattatgagtacttgcccaccatgggcctgaaatcattcatccaggcctctctagcactcctctttggaaagcacagccaagccattgtggagaacagggtagggggtgtacacactgttggtgacagtggtgccttccagcttggcgtccagtttctcagagcttggcataaggatgctcgtatagtttacatcatctcttctcaaaaagaactgcatggactcgtcttccaggacatgggctttacagtttatgaatactctgtctgggaccccaagaagctatgcatggaccccgacatactcctcaatgtggtggagcagatcccacatggctgtgtccttgtgatggggaacattatcgactgcaagttgacaccaagtgggtgggcaaagttgatgtccatgataaagagcaagcagatattcccattttttgatattccctgtcaaggtttatacaccagtgacttggaagaagatactagaatcttacaatactttgtgtctcaaggctttgagttcttctgcagccagtctctgtccaagaattttggcatttatgatgaaggagtggggatgctagtggtggtggcagtcaacaaccagcagctgctgtgtgtcctctcccagctggaaggattagcccaggccctgtggctaaacccccccaacacgggtgcacgtgtcatcacctccatcctctgcaaccctgctctgctgggagaatggaagcagagtctaaaagaagttgtagagaacatcatgctaaccaaggaaaaagtgaaggagaaactccagctcctgggaacccctgggtcctggggtcacatcaccgagcagagtgggacccacggctatcttggactcaactcccagcaggtggaatacctggtcaggaagaagcacatctatatccccaagaacggtcagattaacttcagctgtatcaatgccaacaacataaattacatcactgagggcatcaatgaggctgtcctcctcacagagagctcagagatgtgtcttccaaaggaaaaaaaaacactgattggaataaaactttagtctttgcaaaaa

SEQ ID NO: 137610 - DNA, 497 bp, Homo sapiens
  Payload ID: 6946
  Gene Symbol: GOT1L1
  Gene Name: glutamic-oxaloacetic transaminase 1-like 1
  ENST ID: ENST00000518826
  CDS Start-End: 109-474
ttggaagaagatactagaatcttacaatactttgtgtctcaaggctttgagttcttctgcagccagtctctgtccaagaattttggcatttatgatgaaggagtggggatgctagtggtggtggcagtcaacaaccagcagctgctgtgtgtcctctcccagctggaaggattagcccaggccctgtggctaaacccccccaacacgggtgcacgtgtcatcacctccatcctctgcaaccctgctctgctgggagaatggaagcagagtctaaaagaagttgtagagaacatcatgctaaccaaggaaaaagtgaaggagaaactccagctcctgggaacccctgggtcctggggtcacatcaccgagcagagtgggacccacggctatcttggactcaactgtaagggtctagggggctggtgtcccccctttctgacctttggcctgtatttgagcattaaacttcactgactaggtgaccagttcctagcttc

SEQ ID NO: 137611 - DNA, 600 bp, Homo sapiens
  Payload ID: 6946
  Gene Symbol: GOT1L1
  Gene Name: glutamic-oxaloacetic transaminase 1-like 1
  ENST ID: ENST00000524298
  CDS Start-End: 96-600
ggaggaagacttctgggcagaagcggaacacaggagcagagacacatagtcttggctccagtttcgtttcagttatgcccaccctttcagtgttcatggatgtgcccctcgcccacaagctagagggcagcttgttaaagacctacaaacaagatgattacccgaacaagatattcttagcctatagaggcaccttcccacagccccatggagtccaggagagatttgtttgcaggctgtctgcagagctcagccctgggggcccaaaccaggcatctggagctccctctgtggttttcctcacagtctgcatgacaaatgaaggccatccctgggtttctctcgtggtgcagaagactcgactacagatttcacaggatccctccctgaattatgagtacttgcccaccatgggcctgaaatcattcatccaggcctctctagcactcctctttggaaagcacagccaagccattgtggagaacagggtagggggtgtacacactgttggtgacagtggtgccttccagcttggcgtccagtttctcagagcttggcataaggatgctcgtatagtttacatcatctcttctcaaaaag

SEQ ID NO: 137612 - DNA, 2462 bp, Homo sapiens
  Payload ID: 6947
  Gene Symbol: GOT2
  Gene Name: glutamic-oxaloacetic transaminase 2, mitochondrial
  Uniprot ID: P00505
  ENST ID: ENST00000245206
  CDS Start-End: 130-1422
ccagcacgcggccgctctggcccagggaagtccctgtccttaccttcagcaggagccggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataatggaaagccttacgttctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgcctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaagtcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgctgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaa

SEQ ID NO: 137613 - DNA, 1615 bp, Homo sapiens
  Payload ID: 6947
  Gene Symbol: GOT2
  Gene Name: glutamic-oxaloacetic transaminase 2, mitochondrial
  Uniprot ID: P00505
  ENST ID: ENST00000434819
  CDS Start-End: 99-1262
ccctgtccttaccttcagcaggagccggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataatggaaagccttacgttctgcctagcgtccgcaagtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgcctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaagtcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgaga

SEQ ID NO: 137614 - DNA, 516 bp, Homo sapiens
  Payload ID: 6947
  Gene Symbol: GOT2
  Gene Name: glutamic-oxaloacetic transaminase 2, mitochondrial
  ENST ID: ENST00000568368
  CDS Start-End: 89-268
accttcagcaggagccggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccaggcagaggcccagattgccgcaaaaaatttggacaaggaatacctgcccattgggggactggctgaattttgcaaggcatctgcagaactagccctgggtgagaacagcgaagtcttgaagagtggccgggtaagctgagcaggctctggcatcatcccagtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaa

SEQ ID NO: 137615 - DNA, 1885 bp, Homo sapiens
  Payload ID: 6948
  Gene Symbol: GPT
  Gene Name: glutamic-pyruvate transaminase (alanine aminotransferase)
  Uniprot ID: P24298
  ENST ID: ENST00000394955
  CDS Start-End: 224-1714
agacgggtggggcggggcccaactgtccccagctccttcagccctttctgtccctcccagtgaggccagctgcggtgaagagggtgctctcttgcctggagttccctctgctacggctgccccctcccagccctggcccactaagccagacccagctgtcgccattcccacttctggtcctgccacctcctgagctgccttcccgcctggtctgggtagagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggagctgggcctggcccccgatatgttcttctgcctgcgcctcctggaggagaccggcatctgcgtggtgccagggagcggctttgggcagcgggaaggcacctaccacttccggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctgactcc

SEQ ID NO: 137616 - DNA, 1822 bp, Homo sapiens
  Payload ID: 6948
  Gene Symbol: GPT
  Gene Name: glutamic-pyruvate transaminase (alanine aminotransferase)
  Uniprot ID: P24298
  ENST ID: ENST00000528431
  CDS Start-End: 158-1648
agggctgccacttggactcccttgccagggggcgggcaggggctggctctgcctggggccaggcccatgttaacctgtgccccggcctgggggccagaggggcaggcctgcgcacggggaggctgttgtggcagcggaacagagacgtgcacgagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggagctgggcctggcccccgatatgttcttctgcctgcgcctcctggaggagaccggcatctgcgtggtgccagggagcggctttgggcagcgggaaggcacctaccacttccggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctgactccagg

SEQ ID NO: 137617 - DNA, 4834 bp, Homo sapiens
  Payload ID: 6949
  Gene Symbol: GLS
  Gene Name: glutaminase
  Uniprot ID: O94925
  ENST ID: ENST00000320717
  CDS Start-End: 259-2268
gagccttaggcggagcgaagagaaccggtcgcggcaatcctagcgcgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggtaaagtcagtgataaatcttttgtttgctgcatatactggagatgtgtctgcacttcgaagatttgctttgtcagctatggacatggaacagcgggactatgattctagaacagcactccatgtagctgctgcagagggtcatgttgaagttgttaaatttttgctggaagcctgcaaagtaaaccctttccccaaggacaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgtgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctcaccccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaagtttatcagtctaaaaaacgaagggatgtgcaactgcagctctttaagaagttttttttttttagcttctagggtaaagataaattcagaaatgctctaagctaccaaagttattctgaaagtatgggaactgctacaactaacaaacatttgtttccaagcctgtcattaagagtctgcatcaagagatttgtcctccttgggggaccactggatcattccagatttcttgtgatttttctattgtgtaattcttggtgggctctgtagtttaataataagaaaaaggccatttcattttaaattgtgacctataattctttgtcttgggttggtaattcaggattcatttggaaagtgggtaaaaggggcttcaaaaaacggatagaacaggattttctaggagttacacatacattttatcctgtcatacctcgagataaagtggcatgttagtgaggagttctgatattaagcacacacacacatgcacacaaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctaccccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgctcgggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatcaaaaaaaaaa

SEQ ID NO: 137618 - DNA, 4475 bp, Homo sapiens
  Payload ID: 6949
  Gene Symbol: GLS
  Gene Name: glutaminase
  Uniprot ID: O94925
  ENST ID: ENST00000338435
  CDS Start-End: 252-2048
aggcggagcgaagagaaccggtcgcggcaatcctagcgcgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaaggcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtctttaaaaagtatttacaagtacataaatttgctttatttttaaaaatacaaaaaggaaaaatttaaattttttttgatgtaattaaaatgttaactatgtggtcagataatcccattttacaatagtaacagaaaattgtaattcttagttctaaaattcacaaattaaactcataagttttgttgcattttgttttttcttttccatttttaaaactaatgtgatgtctttagtggcaatagaaggtacttctatgctaaatacaaaactaaaaaggcaaaataatgaaccccaaattattttatttaaaatagcagtggattataaaattagcttgtgtttacatttatgccatttttggtgatagattggctttacattttaaaaaatttatttaaaaatttatcaaatgctttaaaatatgactcctactttttttattttgcaactcctctgttctgtcagagttgttatatacaggagtgtcttatgttactaaaacattccagccaaagaatttcagatgtgagataatgatgtttcatcaataaaaagctataatggttagttactcagaaggagaaacagtgagtgtcttcaagtgaattgttcacctaaacaattttattttcatattatccacataactttttctatgttatatttaaatatgaatggcaaattttggtttttagcttttacattttattatcttaattttataaatgctaatatttcttttgtgataagttatagcatctcataaagtttgttctatttgaagttttttagagtacttgagaaatgaatttagtctgcaggtagtaagtatgctactaaaatacgttagatctaaatccttttatttggtataaaaatgcaatattgagaatcaaaacttgtttttaagagaactatagattctacacaacctgatttcaagtaattattcatagtatttatagttgtcttggcaaagtgattgtaaaattctgtaggacctattcacacttcttccttcttccatatacttctctggttttccccatagttcccctataatttcaagtttgttgaaacctgttaattttagtgggggattagaagaaaaacttggtggtttcttagcatgatggtgtatgtatgtggtaatggaaagtctgtaaaagtaaatatagtgtagcaaaaaagatttcactgagtattttagatactagtgcaaataaagatagaaaatcttgatcataatgtcttaagtttgggaactgtgatattaagaaaagaaattcccttctagaggtgctggccaaaaagccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggaaaaaaggcattgtggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctga

SEQ ID NO: 137619 - DNA, 997 bp, Homo sapiens
  Payload ID: 6949
  Gene Symbol: GLS
  Gene Name: glutaminase
  ENST ID: ENST00000409626
  CDS Start-End: 342-851
atttaagcaaatttgaatatcacatgggataataacaaatcttagtgtttagaggctggcacttcctagtctagttctgccattaaaagactgagtatctttggccaaatcagggtaaatcttaaaagtgggtaggacttcggtcaactaaaatcttcagaatgtcctcaagtttatattaaagtaatctctttggaagaaatatttcagatctgtatgaaataccaaataaaatagattatcttaaaagtgaacagtaatattaaaagtagtatgagaattctgctttttctttgtgttagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaaggcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaa

SEQ ID NO: 137620 - DNA, 632 bp, Homo sapiens
  Payload ID: 6949
  Gene Symbol: GLS
  Gene Name: glutaminase
  ENST ID: ENST00000409215
  CDS Start-End: 99-410
ctcatcccttctgcttttaaggcaatccagtgtacaaggttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaaggcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtctttaaaaagtatttacaagtacataaatttgct

SEQ ID NO: 137621 - DNA, 816 bp, Homo sapiens
  Payload ID: 6949
  Gene Symbol: GLS
  Gene Name: glutaminase
  ENST ID: ENST00000409428
  CDS Start-End: 120-644
tggaagtttgatttatagaacctcatcccttctgcttttaaggcaatccagtgtacaaggttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggtaaagtcagtgataaatcttttgtttgctgcatatactggagatgtgtctgcacttcgaagatttgctttgtcagctatggacatggaacagcgggactatgattctagaacagcactccatgtagctgctgcagagggtcatgttgaagttgttaaatttttgctggaagcctgcaaagtaaaccctttccccaaggacaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaa

SEQ ID NO: 137622 - DNA, 837 bp, Homo sapiens
  Payload ID: 6949
  Gene Symbol: GLS
  Gene Name: glutaminase
  ENST ID: ENST00000417154
  CDS Start-End: 1-345
gaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaaggattggtggtgatcctcaggaaatgggggaagaggcagagcaaatgttcaaaaggattagcagattgtggaaaaaaggagaatttggacagaaggagcctgttgcataaattcttaactactaagcttataggaaaactccaatatttaaaattttaaacaaagctatatagatctacaacttactgctttgtaaacttcgccgagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaa

SEQ ID NO: 137623 - DNA, 821 bp, Homo sapiens
  Payload ID: 6949
  Gene Symbol: GLS
  Gene Name: glutaminase
  ENST ID: ENST00000457316
  CDS Start-End: 330-821
ttgaatatcacatgggataataacaaatcttagtgtttagaggctggcacttcctagtctagttctgccattaaaagactgagtatctttggccaaatcagggtaaatcttaaaagtgggtaggacttcggtcaactaaaatcttcagaatgtcctcaagtttatattaaagtaatctctttggaagaaatatttcagatctgtatgaaataccaaataaaatagattatcttaaaagtgaacagtaatattaaaagtagtatgagaattctgctttttctttgtgttagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggtaaagtcagtgataaatcttttgtttgctgcatatactggagatgtgtctgcacttcgaagatttgctttgtcagctatggacatggaacagcgggactatgattctagaacagcactccatgtagct

SEQ ID NO: 137624 - DNA, 693 bp, Homo sapiens
  Payload ID: 6949
  Gene Symbol: GLS
  Gene Name: glutaminase
  ENST ID: ENST00000412247
  CDS Start-End: 1-549
gcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggtaaagtcagtgataaatcttttgtttgctgcatatactggagatgtgtctgcacttcgaagatttgctttgtcagctatggacatggaacagcgggactatgattctagaacagcactccatgtagctgctgcagagggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaa

SEQ ID NO: 137625 - DNA, 2623 bp, Homo sapiens
  Payload ID: 6950
  Gene Symbol: GLS2
  Gene Name: glutaminase 2 (liver, mitochondrial)
  Uniprot ID: Q9UI32
  ENST ID: ENST00000311966
  CDS Start-End: 280-2088
cacccactagaaagccacccgggttctccttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtgtgtgagcagcaacattgtgctcctgacccaggcattccgaaagaagtttgtcattcctgattttgaggagttcacgggccatgtggatcgcatctttgaggatgtcaaagagctcactggaggcaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatctcaaggaaaagaagtgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatca

SEQ ID NO: 137626 - DNA, 2225 bp, Homo sapiens
  Payload ID: 6950
  Gene Symbol: GLS2
  Gene Name: glutaminase 2 (liver, mitochondrial)
  ENST ID: ENST00000424141
  CDS Start-End: 12-545
cttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatctcaaggaaaagaagtgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatca

SEQ ID NO: 137627 - DNA, 567 bp, Homo sapiens
  Payload ID: 6950
  Gene Symbol: GLS2
  Gene Name: glutaminase 2 (liver, mitochondrial)
  ENST ID: ENST00000461077
  CDS Start-End: 15-567
aggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaaatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatctcaa

SEQ ID NO: 137628 - DNA, 798 bp, Homo sapiens
  Payload ID: 6950
  Gene Symbol: GLS2
  Gene Name: glutaminase 2 (liver, mitochondrial)
  ENST ID: ENST00000483347
  CDS Start-End: 297-485
aggcaccgccctctctccacccactagaaagccacccgggttctccttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcagcactaaaggccactggactgcagacatcagatcctcggctccgagactgcatgagcgagatgcaccgcgtggtccaagagtccagtagtggtggcctcttggaccgagatctcttccgaaagtgtgtgagcagcaacattgtgctcctgacccaggcattccgaaagaagtttgtcattcctgattttgaggagttcacgggccatgtggatcgcatctttgaggatgtcaaagagctcactggaggcaaagtggcagcctacatccctcagctggccaagtcaaacccagacctgtggggtgtctccctgtgcactgt

SEQ ID NO: 137629 - DNA, 1845 bp, Homo sapiens
  Payload ID: 6950
  Gene Symbol: GLS2
  Gene Name: glutaminase 2 (liver, mitochondrial)
  ENST ID: ENST00000479952
  CDS Start-End: 35-508
gggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtgttgcagtatctcaacaaaatggctgggaatgaatacatgggtttcagcaatgccactgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatca

SEQ ID NO: 137630 - DNA, 1509 bp, Homo sapiens
  Payload ID: 6950
  Gene Symbol: GLS2
  Gene Name: glutaminase 2 (liver, mitochondrial)
  Uniprot ID: Q9UI32
  ENST ID: ENST00000486896
  CDS Start-End: 132-761
attctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagcattccgaaagaagtttgtcattcctgattttgaggagttcacgggccatgtggatcgcatctttgaggatgtcaaagagctcactggaggcaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtaagttcccttgctacttagcccctggctgcatttcgccatggcatgctgtcctctccagctgccccagtggctctctaaccccactaccaggtgcaccagcccatactagaagccttatttccagaaatgtggaaatctgctggcctcagagaggaaagcctcttgacaagacctgagttcagaagggctagtcaacctgtgaggtattaatagagcttcttaaccaagtggagcctcaatgtccctttttctcttccaggtgttgcagtatctcaacaaaatggctgggaatgaatacatgggtttcagcaatgccacggaaggtaatttttccccttctcccaacacccactcctccaacttcaagtactaaattgggtgtttgcttcagattccagtcagagaaggaaacaggggatcggaattatgccatcggctattatctcaaggaaaagaagtgctttcctaagggggtggacatgatggctgcccttgatctctacttccagctgtgttctgtggaggtcacttgtgaatca

SEQ ID NO: 137631 - DNA, 936 bp, Homo sapiens
  Payload ID: 6950
  Gene Symbol: GLS2
  Gene Name: glutaminase 2 (liver, mitochondrial)
  ENST ID: ENST00000494474
  CDS Start-End: 251-562
ttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatctcaaggaaaagaagtgctttcctaagggggtggacatgatggctgcccttgatctc

SEQ ID NO: 137632 - DNA, 2694 bp, Homo sapiens
  Payload ID: 6950
  Gene Symbol: GLS2
  Gene Name: glutaminase 2 (liver, mitochondrial)
  ENST ID: ENST00000486433
  CDS Start-End: 280-1263
cacccactagaaagccacccgggttctccttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtgtgtgagcagcaacattgtgctcctgacccaggcattccgaaagaagtttgtcattcctgattttgaggagttcacgggccatgtggatcgcatctttgaggatgtcaaagagctcactggaggcaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacggaaggtaatttttccccttctcccaacacccactcctccaacttcaagtactaaattgggtgtttgcttcagattccagtcagagaaggaaacaggggatcggaattatgccatcggctattatctcaaggaaaagaagtgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaat

SEQ ID NO: 137633 - DNA, 2174 bp, Homo sapiens
  Payload ID: 6950
  Gene Symbol: GLS2
  Gene Name: glutaminase 2 (liver, mitochondrial)
  ENST ID: ENST00000539272
  CDS Start-End: 1-843
atgttgcagaaggaggagcaggtagcagttctcaggccccactttcctccccattctctgcccccaaacagtgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtgtgtgagcagcaacattgtgctcctgacccaggcattccgaaagaagtttgtcattcctgattttgaggagttcacgggccatgtggatcgcatctttgaggatgtcaaagagctcactggaggcaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccactgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatcatttttgct

SEQ ID NO: 137634 - DNA, 2296 bp, Homo sapiens
  Payload ID: 6950
  Gene Symbol: GLS2
  Gene Name: glutaminase 2 (liver, mitochondrial)
  ENST ID: ENST00000610413
  CDS Start-End: 740-1753
aggcaccgccctctctccacccactagaaagccacccgggttctccttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatctcaaggaaaagaagtgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatcatttttgct

SEQ ID NO: 137635 - DNA, 2518 bp, Homo sapiens
  Payload ID: 6950
  Gene Symbol: GLS2
  Gene Name: glutaminase 2 (liver, mitochondrial)
  ENST ID: ENST00000623608
  CDS Start-End: 962-1975
aggcaccgccctctctccacccactagaaagccacccgggttctccttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatctcaaggaaaagaagtgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatcatttttgct

SEQ ID NO: 137636 - DNA, 9335 bp, Homo sapiens
  Payload ID: 6951
  Gene Symbol: QSER1
  Gene Name: glutamine and serine rich 1
  Uniprot ID: Q2KHR3
  ENST ID: ENST00000399302
  CDS Start-End: 336-5543
cgcccgcgccccccgccgcccccgtccccgccagcgccgctgcgcagccccccgccccagcctgggcgtacgaaccccgagccgccgccgccgccgccagcagcagctgcagcagtggcagctgcagtagcggcagcagccccagcctcaaggccagtttaagctatgaagaaggacatccctcacactctgaaacagatctccttcagagacagagttttgcagcctctcatcagcttcctggatatgctcccacacctcagcctactggtctttctggaatatttgatactagtgtgaacagtgccagcagtaacactaaagagtcttcagtgatgaattttctgtctactgctgaatcccgaactgctcaggctgctgcttcaggaactactctcttaccacaattcagggctccatcctggcagacaggcatgcattcctcagcagcaactgagctgtttgctactggacctttgccaagcactggaacacttccaccatctctctctgcttatcagcatcccaccaccttcagcaatagaaactttgctaccacttcacctttggtgcttcaggattcaacttttaacactacatcaaatggaattttaagtcatcatgaccctttgctacaaatcaagacttcccagggaactgttccaactgctttggcatttgagcgcctgggcagttctgtattaagtaacagcataccacctcagtcttcaacataccgctcagctcaagagtctgcaccccatcttttacaacctcaatttagtttgttgccttcagcacttgggggatcccagcagactcctcaagcctacagttcaactctctttactagttctactgcttccattgaaagagctcttcttcgagaatgtagtgttattaaacaccatcagcggccttcaggtacccagtcaattcaggcacaactgactggttcacagcactccttacatagttatctatcaaattcaagtgtagttaattttcaggaaacaaccaggcagtcatctttatcctgtagcccaattggagattccactcaggtgagcaacggaggattacaacagaagacctcccaggtctcagtggaacttgctcagtcttactcatctgcgattccatcatcagggtatcctccttctactacaaaaataaaaagctgttctacagaacaaccactgacatcaaccaagacccctaaacctcaaagtataattcctcctgtgcaaacactaagctattccaaacctttacataatcagagttctgtaatatcgggccaagcacaaatttattctacagcgcagctaccaagccttttatcagttagtcagtcccaaaattacggtttagtacagccacataatgtgccatctattgttcattcacaggtttataggtccagcaaggttgagaaattgccacccttgtataaaacattgactttttctgggtcatctcagactgtaactcctgaaaatcagacgcttaattattcatctaatcagcaagaggtattgtcttcagttacaaatgagaattaccctgctcaaacaagagatctgtcttcagtaagtcagtctcaaagttactcatctggtcactctcagggtttatcaccagttagccagacacaggttagctattcatctcaatcacaagttttgtcagttgttagtctttcagaaagctatgcttcaggggagtccctaacattaacagccccttctctttcttattcttctgcctctcgggctcagaatttgccagactctagcccgacccagaattatatttctatgcattcttcccaaaatgttcagactcaagagtcatcatctccccagtcccagaagtttttgcctgctgtccagtcatcatcttttgcatcctctactcattgtcagacattacaaaataacataacttcccctgacccaaagtcttatgctgaaagaaagcttgactcagatgtgtatccatcttcaaagcaagaagatggttttccaatgcaagagttacaggtgttgcagccacaagcatctcttgagtcatcaacccaaaggctatctgatggagaaattaatgctcaagaatcaacttataaggtgtcaaaggcagatgacagatattctcagagtgtaatcagaagtaattcccgtcttgaagatcaagttattggggttgctctgcaagcatcaaaaaaagaagaaagtgttgttggttcagtgacacaacttaaccaacaaattggccaagtcaataatgcagctacccttgatcttaagaactcaactaatttaatacagactccacaaataaggttgaatactaaagacttaaagcagcaacatcctctcatacttaaggtgcatgagtccaaggtccaggaacagcacgatcaaataattaatgcttcatctcagattcaaattccaaatcatgctttagggcatggccatcaggcatctcttcctaatacacaggtccttttagattctgcctgtgatttacaaattcttcagcagtcaatactgcaggcaggtttaggtcaagtaaaggcatctttacaagcacagcgtgttcaaagccctcaacaaatagtacatcccttccttcagatggaaggtcatgttattcaaagcaatggtgatcattctcagcagcaactccatcctcaaaattctgaagttatgaaaatggacctctctgagtcttcaaaaccattacaacaacatctaacaacaaagggccattttagtgaaacaaatcaacatgattcaaagaatcagtttgtttctcttggatcgatgtgtttcccagaggcagtgcttcttagtgatgaaagaaatattttatcaaatgtagatgatatcttagcagctacagcagcagcttgtggagttacacctactgatttttccaagtcaacttcaaatgaaaccatgcaggctgttgaagatggtgattctaaatctcattttcagcagtcattagatgtcaggcatgtgacttcagattttaactctatgacagctacagtaggaaagccacagaatataaatgatacttccttaaatggaaatcaggttactgtgaacctttcaccagtacctgcccttcagtcaaaaatgactcttgatcaacagcacattgaaacacctggtcaaaatataccaactaaagtaacttcagcagtggttggaccaagtcatgaagtccaggagcaaagttctggcccattcaagaaacagtctgctaccaatcttgaatctgaagaagacagtgaagctcctgttgatagtacattaaataataacagaaaccaagagtttgtttctagtagtagaagtataagtggagagaatgctacatcagagagtgaatttaccttagggggtgacgacagtggtgtgtcaatgaacccagctaggagtgcacttgcactgttggccatggcccaatctggggatgcagtcagtgtcaagattgaagaagaaaaccaagatttaatgcattttaaccttcaaaagaaaagagctaaaggaaaagggcaagttaaagaggaagacaacagtaatcagaaacagctgaaaagacctgcccaaggcaaacgccagaatccaaggggaacagatatttacttaccgtatactcctccttcctcagaaagctgccatgatggttatcagcatcaagaaaaaatgagacagaagatcaaagaggtggaggaaaaacaaccagaagtcaaaacaggatttattgcttctttcttagattttctgaaatccgggcccaagcagcagttttccactcttgctgtacgaatgcctaacaggactagacggccagggacccagatggttcgtacattttgtcccccaccacttcccaagccttcatctacaacacccacacctttagtgtctgaaactggcggtaacagtccatcagataaagttgataatgaacttaaaaacttggaacatttatcttcattttcttctgatgaagatgatcctggatatagtcaagatgcttataaaagcgtctctactcccttaactactttggatgctacttctgataaaaagaagaaaacagaagccctacaggtggcaactactagcccaactgccaatactactggtactgctactacttcctcaaccactgtgggtgcagttaagcaagaacctctccactctacttcatatgcagtaaatattctggaaaatataagctcttcagaatcctcaaagcccattgaacttgatggtcttccttcagaccagtttgcaaaaggacaggacactgttgccatagaaggttttacagatgaggaggacacagaaagcggaggagaaggccaatacagagagcgtgatgaatttgtggtaaagatagaagacatagagacttttaaggaggctttaaaaacaggaaaagaacctccagctatttggaaagtacaaaaagctttattacagaaatttgttcctgaaattcgagatggtcaaagagaatttgctgctacaaatagttatcttggatattttggagatgcaaagagtaaatacaaaagaatatatgtgaagttcattgaaaatgcaaacaagaaggaatatgtcagagtgtgttctaaaaagccaagaaataaaccttcacaaactatcagaactgttcaagctaagccaagtagtagcagtaaaacttctgatcctctagcatcaaaaactacaactacaaaagccccttccgtgaaacccaaagttaaacagccaaaagtaaaggctgagccaccaccaaagaaacggaaaaaatggaaagaagaattttcatcatcccaatctgactcatctcctgagatccatactagtagtagtgacgatgaggaatttgaacctcccgctccctttgtcactcgctttttgaacacaagagcaatgaaggaaacctttaagagctacatggaattgcttgttagcattgccttggaccctgacacaatgcaagccttagagaagagcaatgatgagctacttttacctcatatgaaaaaaatagatggcatgctaaatgataaccgaaagagacttcttttgaatcttcatttggatcaatcattcaagaatgctttggaaagttttcctgaactaacaataattactcgagattctaaagcaaagagtggaggaactgctatttctaaaatcaaaatgaatggcaaagcctataataagaaaactctaaggacttctaaaacaaccaccaaatctgcacaagagtttgctgtcgatccagagaaaatacagttgtattctttgtatcattcactccatcattataagtaccatgtttatctgatatgtaaggatgagatttcttcggtgcagaaaaaaaatgaagatttaggacaggaggaaattgttcaactttgtatgaaaaatgtaaaatgggtggaggacctctttgaaaaatttggagaacttctaaatcatgtacagcagaaatgttcctgacttttccacaaaaatcccatctttttatagcactaatgaaatggcagatatggggtggtcaaagataatcagatgtcaagtagtggccttctgcaggccggccgcttccatcatggaactgtcattaccacctctgctgaaggacagtggtgcggcctttaggaacgaagttagtcctctggaaatggacctaaatcccaccacatttttaccctaatgaatgatttttctattttgtaaaccattgggtaacttgagtcatattttcagaaacattttttgacaaatgatgaagcatgcactaagtataatttttttttattgctagagaagtaacacttaaagtaacgattttttttttctgactccggctaaacaccagaatgacagagaagtggcagaaaccatatgtttgtactcacatctggccacaaaaccagaaatactgtacattatgtaaagaggtctggtgtggtgtgacatcctgtataagaatatcatcaatttaaaatataaaatttggaaactattctgctttacagactccttttactcttaacatgttcaggaaactggatgtggaattggtgcaattctctgactgctttttgtgtcaaattatattgtgataaaaaaacaatgacatactattttccctatcgcaaagaaaagtattttcgtttatactgttttttcctttggaaaattttcaattgtacattttatttcactgatagttgtatttttcacaaggaaaatgttgtggttataattacgtttgatatatctctacaacaccttttgttattttcagtaaatcttagttatatgttgaatttctaatgtgaattctatcttgaggtaaccatttttttcatacagatttgcttcagtgttatccagaatatgcattcagtactagaattagtttagctttataaatagggctgtgttagacactgcagtaattttctaattcataaaataaacttcttactaaactagcacttgattaacttgttgaggtaaaaatctaactacatttacattttgaagaataaaactgataattagactatttgcagtgttaaacacagcttccttaactcttagaactggaagttgtagagctctccttttggtgcctttccagcctttatacacactattgtagctttcttaggtttgataggtagcgtttcaagtagtttagctgagacagtgaatgtattaggttcaacatgaccttgtgttttatttgtgtttgccaacaggatgccttatttgtttgagaaaaagatgtactagtgtcattctaaactatctccttttttaggattctaaagaagttaatcatcatccttttgtttattttaccaccatttagtgccttaaatcctatcaagaaagcagtgttactgctcaatgcccaaataagacacgcggatattgctattgtcttgcttttgagttaacaggccaactttttatacttaaaacctcagtaaactggcaaagaattgaaggtaatgtgatttgatttgagaataaaacattgtagcattgggtgaaaaatgagtatttgagttaagcttacatatttatttctgatggttatcttattaaaagcaataatccttaatactgtacttgccattagactaggtactcagtaatggaagtttctctcaagggttaaatgttccatttttgaaagttttaaaaaacctgtttgggtggtttattttgaaaacaaaagtaacctattagattcattttgcctaactcatatgagagatgcagagtatcaacagtgggagcatcataaaatgaattttccaagtggagaggagtaggaagcagccatatgatagtattgactctggacagaattgatgtctttcgtttccaaagtgcagagtagggaactacatttcctaatgtggcattgtaaatatacatctttatattactcttccagcctacgttcctaaatcattgataatttaaatattttttaaagccaccttaatttaggtagctcttggaatcgatgtttgaattcactagccacattttcttcatgatatgcctcgtggcaaacaaagatgtttccttaagatgaatcttacatttcccatagaaaataacccatttcctttggcactgcagttgccctcaaactgcttgcagttgtattcattttagtacaacaaaggttttcataatatgggaggccaagtctatgatactgcctcaaagagaccctattgtgtagatgcatcatcttctctcatttgatccatagagcataggcaaagatgtcaacctcaggccttagagaaaagtggaaatgttattatgacagccgtccatgagttatcgctttgtatgaagttaaatacagtcatgcgttgcttaacagcagggatacattctgagaaatgcattgttaggcaattccgttgtgcgaacatcctagtgtacttacacaaacctaggtggcatagcccacaacgtacccaggctatatggtaaacctgtacagcatgttactgtactgaatactgtaggcagttgtaacacaatggtatttgtgtatctagacatagaaaacatacagtaagaatatggtattataatcttacgggaccactgtcaaatacgcggtctgtctttgaaaagttgtaatgcggcgcatgactataaatacctagctggttagcatttacattccttgccagggagtttgaaatttatactatagaaataactttaggttttaggtagagttaaagaggtaaagcacatgttgccacaacccaggaaagtatttttaagaaagattggattttcctacctttagagatctaaaaaaaatttaatataaaaaatcattttgtgttggtgtttattactagttcagatgagtggctgctgaaggggcccccttgtcattttcattataacccaatttccacttatttgaactcttaagtcataaatgtataatgacttatgaattagcacagttaagttgacactagaaactgcccatttctgtattacactatcaaataggaaacattggaaagatggggaaaaaaatcttattttaaaatggcttagaaagttttcagattactttgaaaattctaaacttctttctgtttccaaaacttgaaaatatgtagatggactcatgcattaagactgttttcaaagctttcctcacatttttaaagtgtgattttccttttaatatacatatttattttctttaaagcagctatatcccaacccatgactttggagatatacctataaaaccaatataacagcagggttattgaagcagctttctcaaatgttgcttcagatgtgcaagttgcaaattttattgtatttgtagaatacaatttttgttttaaactgtatttcaatctatttctccaagatgcttttcatatagagtgaaatatcccaggataactgcttctgtgtcagtcgcatttgacgcataactgcacaaatgaacagtgtatactcttggttgtgcattaacttacatgtataatttttggcatctgtgttcacaaatgcatgtgttagcaaatcacctttatttataagtgacaataattgaagttaaggatataaagaaacctgcatttgtagtccagcgttttcatttggtccataacacaatgtatggaaatgtgaaagacaattttgtacatttgtttgttactaactcagatcattaaaatgaaaacaatttttttaaacaag

SEQ ID NO: 137637 - DNA, 2416 bp, Homo sapiens
  Payload ID: 6951
  Gene Symbol: QSER1
  Gene Name: glutamine and serine rich 1
  ENST ID: ENST00000524678
  CDS Start-End: 1-2342
agtctgctaccaatcttgaatctgaagaagacagtgaagctcctgttgatagtacattaaataataacagaaaccaagagtttgtttctagtagtagaagtataagtggagagaatgctacatcagagagtgaatttaccttagggggtgacgacagtggtgtgtcaatgaacccagctaggagtgcacttgcactgttggccatggcccaatctggggatgcagtcagtgtcaagattgaagaagaaaaccaagatttaatgcattttaaccttcaaaagaaaagagctaaaggaaaagggcaagttaaagaggaagacaacagtaatcagaaacagctgaaaagacctgcccaaggcaaacgccagaatccaaggggaacagatatttacttaccgtatactcctccttcctcagaaagctgccatgatggttatcagcatcaagaaaaaatgagacagaagatcaaagaggtggaggaaaaacaaccagaagtcaaaacaggatttattgcttctttcttagattttctgaaatccgggcccaagcagcagttttccactcttgctgtacgaatgcctaacaggactagacggccagggacccagatggttcgtacattttgtcccccaccacttcccaagccttcatctacaacacccacacctttagtgtctgaaactggcggtaacagtccatcagataaagttgataatgaacttaaaaacttggaacatttatcttcattttcttctgatgaagatgatcctggatatagtcaagatgcttataaaagcgtctctactcccttaactactttggatgctacttctgataaaaagaagaaaacagaagccctacaggtggcaactactagcccaactgccaatactactggtactgctactacttcctcaaccactgtgggtgcagttaagcaagaacctctccactctacttcatatgcagtaaatattctggaaaatataagctcttcagaatcctcaaagcccattgaacttgatggtcttccttcagaccagtttgcaaaaggacaggacactgttgccatagaaggttttacagatgaggaggacacagaaagcggaggagaaggccaatacagagagcgtgatgaatttgtggtaaagatagaagacatagagacttttaaggaggctttaaaaacaggaaaagaacctccagctatttggaaagtacaaaaagctttattacagaaatttgttcctgaaattcgagatggtcaaagagaatttgctgctacaaatagttatcttggatattttggagatgcaaagagtaaatacaaaagaatatatgtgaagttcattgaaaatgcaaacaagaaggaatatgtcagagtgtgttctaaaaagccaagaaataaaccttcacaaactatcagaactgttcaagctaagccaagtagtagcagtaaaacttctgatcctctagcatcaaaaactacaactacaaaagccccttccgtgaaacccaaagttaaacagccaaaagtaaaggctgagccaccaccaaagaaacggaaaaaatggaaagaagaattttcatcatcccaatctgactcatctcctgagatccatactagtagtagtgacgatgaggaatttgaacctcccgctccctttgtcactcgctttttgaacacaagagcaatgaaggaaacctttaagagctacatggaattgcttgttagcattgccttggaccctgacacaatgcaagccttagagaagagcaatgatgagctacttttacctcatatgaaaaaaatagatggcatgctaaatgataaccgaaagagacttcttttgaatcttcatttggatcaatcattcaagaatgctttggaaagttttcctgaactaacaataattactcgagattctaaagcaaagagtggaggaactgctatttctaaaatcaaaatgaatggcaaagcctataataagaaaactctaaggacttctaaaacaaccaccaaatctgcacaagagtttgctgtcgatccagagaaaatacagttgtattctttgtatcattcactccatcattataagtaccatgtttatctgatatgtaaggatgaggtaatttcttctcatttacttaaaaaaaatgtttttcagaatgttaaggagactctagccatagtattttggagtgttttaaagagagttgtgaaatacatgtgtgtatgtattttgtctatgtattctgtaaataatgacttgatttattgttctgagtctctctgctatgttttgtgctcagatttacccgagcctcaccacctcttgtaggagctataattggtaatgttttgaagctgttggtgcttgctttacatcgccataataaatgatgttttattgca

SEQ ID NO: 137638 - DNA, 5052 bp, Homo sapiens
  Payload ID: 6951
  Gene Symbol: QSER1
  Gene Name: glutamine and serine rich 1
  Uniprot ID: Q2KHR3
  ENST ID: ENST00000527788
  CDS Start-End: 357-4946
agtcccagctacttgggaggctgaggcaggaggattgcttgagcccaggagttggaggctacaataagctatgatccagctgctgcactctagcttgggtgacagagaccctgtcttcttaagacaaatccagaatttgggacatcttataatttagttgccctggattcttcaaaagtttaagctatgaagaaggacatccctcacactctgaaacagatctccttcagagacagagttttgcagcctctcatcagcttcctggatatgctcccacacctcagcctactggtctttctggaatatttgatactagtgtgaacagtgccagcagtaacactaaagagtcttcagtgatgaattttctgtctactgctgaatcccgaactgctcaggctgctgcttcaggaactactctcttaccacaattcagggctccatcctggcagacaggcatgcattcctcagcagcaactgagctgtttgctactggacctttgccaagcactggaacacttccaccatctctctctgcttatcagcatcccaccaccttcagcaatagaaactttgctaccacttcacctttggtgcttcaggattcaacttttaacactacatcaaatggaattttaagtcatcatgaccctttgctacaaatcaagacttcccagggaactgttccaactgctttggcatttgagcgcctgggcagttctgtattaagtaacagcataccacctcagtcttcaacataccgctcagctcaagagtctgcaccccatcttttacaacctcaatttagtttgttgccttcagcacttgggggatcccagcagactcctcaagcctacagttcaactctctttactagttctactgcttccattgaaagagctcttcttcgagaatgtagtgttattaaacaccatcagcggccttcaggtacccagtcaattcaggcacaactgactggttcacagcactccttacatagttatctatcaaattcaagtgtagttaattttcaggaaacaaccaggcagtcatctttatcctgtagcccaattggagattccactcagaatttgccagactctagcccgacccagaattatatttctatgcattcttcccaaaatgttcagactcaagagtcatcatctccccagtcccagaagtttttgcctgctgtccagtcatcatcttttgcatcctctactcattgtcagacattacaaaataacataacttcccctgacccaaagtcttatgctgaaagaaagcttgactcagatgtgtatccatcttcaaagcaagaagatggttttccaatgcaagagttacaggtgttgcagccacaagcatctcttgagtcatcaacccaaaggctatctgatggagaaattaatgctcaagaatcaacttataaggtgtcaaaggcagatgacagatattctcagagtgtaatcagaagtaattcccgtcttgaagatcaagttattggggttgctctgcaagcatcaaaaaaagaagaaagtgttgttggttcagtgacacaacttaaccaacaaattggccaagtcaataatgcagctacccttgatcttaagaactcaactaatttaatacagactccacaaataaggttgaatactaaagacttaaagcagcaacatcctctcatacttaaggtgcatgagtccaaggtccaggaacagcacgatcaaataattaatgcttcatctcagattcaaattccaaatcatgctttagggcatggccatcaggcatctcttcctaatacacaggtccttttagattctgcctgtgatttacaaattcttcagcagtcaatactgcaggcaggtttaggtcaagtaaaggcatctttacaagcacagcgtgttcaaagccctcaacaaatagtacatcccttccttcagatggaaggtcatgttattcaaagcaatggtgatcattctcagcagcaactccatcctcaaaattctgaagttatgaaaatggacctctctgagtcttcaaaaccattacaacaacatctaacaacaaagggccattttagtgaaacaaatcaacatgattcaaagaatcagtttgtttctcttggatcgatgtgtttcccagaggcagtgcttcttagtgatgaaagaaatattttatcaaatgtagatgatatcttagcagctacagcagcagcttgtggagttacacctactgatttttccaagtcaacttcaaatgaaaccatgcaggctgttgaagatggtgattctaaatctcattttcagcagtcattagatgtcaggcatgtgacttcagattttaactctatgacagctacagtaggaaagccacagaatataaatgatacttccttaaatggaaatcaggttactgtgaacctttcaccagtacctgcccttcagtcaaaaatgactcttgatcaacagcacattgaaacacctggtcaaaatataccaactaaagtaacttcagcagtggttggaccaagtcatgaagtccaggagcaaagttctggcccattcaagaaacagtctgctaccaatcttgaatctgaagaagacagtgaagctcctgttgatagtacattaaataataacagaaaccaagagtttgtttctagtagtagaagtataagtggagagaatgctacatcagagagtgaatttaccttagggggtgacgacagtggtgtgtcaatgaacccagctaggagtgcacttgcactgttggccatggcccaatctggggatgcagtcagtgtcaagattgaagaagaaaaccaagatttaatgcattttaaccttcaaaagaaaagagctaaaggaaaagggcaagttaaagaggaagacaacagtaatcagaaacagctgaaaagacctgcccaaggcaaacgccagaatccaaggggaacagatatttacttaccgtatactcctccttcctcagaaagctgccatgatggttatcagcatcaagaaaaaatgagacagaagatcaaagaggtggaggaaaaacaaccagaagtcaaaacaggatttattgcttctttcttagattttctgaaatccgggcccaagcagcagttttccactcttgctgtacgaatgcctaacaggactagacggccagggacccagatggttcgtacattttgtcccccaccacttcccaagccttcatctacaacacccacacctttagtgtctgaaactggcggtaacagtccatcagataaagttgataatgaacttaaaaacttggaacatttatcttcattttcttctgatgaagatgatcctggatatagtcaagatgcttataaaagcgtctctactcccttaactactttggatgctacttctgataaaaagaagaaaacagaagccctacaggtggcaactactagcccaactgccaatactactggtactgctactacttcctcaaccactgtgggtgcagttaagcaagaacctctccactctacttcatatgcagtaaatattctggaaaatataagctcttcagaatcctcaaagcccattgaacttgatggtcttccttcagaccagtttgcaaaaggacaggacactgttgccatagaaggttttacagatgaggaggacacagaaagcggaggagaaggccaatacagagagcgtgatgaatttgtggtaaagatagaagacatagagacttttaaggaggctttaaaaacaggaaaagaacctccagctatttggaaagtacaaaaagctttattacagaaatttgttcctgaaattcgagatggtcaaagagaatttgctgctacaaatagttatcttggatattttggagatgcaaagagtaaatacaaaagaatatatgtgaagttcattgaaaatgcaaacaagaaggaatatgtcagagtgtgttctaaaaagccaagaaataaaccttcacaaactatcagaactgttcaagctaagccaagtagtagcagtaaaacttctgatcctctagcatcaaaaactacaactacaaaagccccttccgtgaaacccaaagttaaacagccaaaagtaaaggctgagccaccaccaaagaaacggaaaaaatggaaagaagaattttcatcatcccaatctgactcatctcctgagatccatactagtagtagtgacgatgaggaatttgaacctcccgctccctttgtcactcgctttttgaacacaagagcaatgaaggaaacctttaagagctacatggaattgcttgttagcattgccttggaccctgacacaatgcaagccttagagaagagcaatgatgagctacttttacctcatatgaaaaaaatagatggcatgctaaatgataaccgaaagagacttcttttgaatcttcatttggatcaatcattcaagaatgctttggaaagttttcctgaactaacaataattactcgagattctaaagcaaagagtggaggaactgctatttctaaaatcaaaatgaatggcaaagcctataataagaaaactctaaggacttctaaaacaaccaccaaatctgcacaagagtttgctgtcgatccagagaaaatacagttgtattctttgtatcattcactccatcattataagtaccatgtttatctgatatgtaaggatgagatttcttcggtgcagaaaaaaaatgaagatttaggacaggaggaaattgttcaactttgtatgaaaaatgtaaaatgggtggaggacctctttgaaaaatttggagaacttctaaatcataccggaatgttgggagaaatgcaaagcgtctcagttagcagcaccagaagatcagagcagcagaatattctagaggctgggaagtccaagatcaaggtacctgtatctggtgactgttgagagccttcttgctgtgccttagaatgaaagaaggtggagggcaaggtgatatgaacaatgtgcctttacatggcaaaagaatgaaagaaagtaaacctattcccac

SEQ ID NO: 137639 - DNA, 818 bp, Homo sapiens
  Payload ID: 6951
  Gene Symbol: QSER1
  Gene Name: glutamine and serine rich 1
  ENST ID: ENST00000528155
  CDS Start-End: 627-818
attccatagaatactataattagagaggttatggaggttatttcatctggtcctttttttatacagatgaaattagtccaacaataattgagtcccttatttaaattacactgtaagccagaagtagagcctgtacaatgaattcacctctctgttgtccaggatattactttttcttctgtaccacattacctctcccagtaaaaagactcttgtttgaggtagaattgaattaaagaaaatactgtgtattatttttcttactaatgcatcttaaatatatttcctccattgtgatagtattgtcagactgtgtttgatccacgaatctataggtcaggaaattggtcaaaggtttctactacttttatagttgttcttctagaagttttttttatcagatggtttggactgtgtattttggtcactgatttttaatgtcctctagtttaagctatgaagaaggacatccctcacactctgaaacagatctccttcagagacagagttttgcagcctctcatcagcttcctggatatgctcccacacctcagcctactggtctttctggaatatttgatactagtgtgaacagtgccagcagtaacactaaagagtcttcagtgatgaattttctgtctactgctgaatcccgaactgctcaggctgctgcttcaggaactactctcttaccacaattcagggctccatcctggcagacaggcatgcattcctcagcagcaactgagctgtttgctactggacctttgccaagcactggaacacttccaccatctctctctgcttatcagcatccc

SEQ ID NO: 137640 - DNA, 5359 bp, Homo sapiens
  Payload ID: 6952
  Gene Symbol: QRICH2
  Gene Name: glutamine rich 2
  Uniprot ID: Q9H0J4
  ENST ID: ENST00000262765
  CDS Start-End: 181-5172
ggcggccaggtggaggacctgagcaagcagctcaagcgtgtggacggccaggtgcagggcatcgccacgcacgtgcagcacttctcccaggccagcgggcttgacctggccgcgctagagtggccggaggagcaggaggtgggcgtgcgggcgttcgatagggtgcggactgggagtatcatgaaggacgccgccgaggagctcagctttgccagggtacttttacagcgggttgatgaactagagaagctattcaaagatcgggagcaattcctggaactagtcagccggaagctgagtttggttcctggtgcagaagaagtcaccatggtcacctgggaagagctggagcaggcgattacggacggctggagagcctcacaagcgggctcagaaacacttatgggattttctaagcacggagggttcacttccttaacatcacctgaagggactctaagcggagactctaccaagcaaccaagtattgagcaggctctggattctgccagtggtcttggcccggatcggactgcatcaggatctggtggcacagcacacccctctgatggggtttccagtagggaacaaagcaaggtcccctctggtactgggagacagcagcagccgagggcccgtgatgaagctggcgtgccacgactccatcagtcttctacattccaattcaaatcagactcagatcgtcacaggagtagagagaagcttacctcgacacaaccaagaagaaatgcacgtcctggtccagttcaacaggacttacccttggccagagaccagcccagtagtgtgcccgctagccagagtcaggtccatctaaggccagatcgtcgtgggttagaaccaactggcatgaatcagcctggattagtgcctgctagcacttacccacatggtgtggtacccctcagcatgggtcagcttggtgtgccaccacctgaaatggatgatcgggaattgataccatttgtcgtggatgagcaacgtatgttgccaccatcagtacctggcagagaccagcaaggattggaactacctagcacagaccaacatggtctggtttcagtcagtgcatatcagcatggtatgacatttcctggcacagaccaacgcagtatggaaccacttggcatggatcagcgtggatgtgtaatatcaggcatgggtcagcaaggactagtaccccctggtatagaccagcaaggattgacattgcctgtcgtcgatcaacatggcctggttctaccttttacagaccagcatggtttggtatcacctggtttgatgccaattagtgcagatcagcaaggttttgtgcagcccagtttggaagcaactggcttcatacaacctggcacagagcagcatgatttgatccagtctggcagatttcagcgtgctttggtgcagcgtggtgcatatcagcctggcttggtccaacctggtgcagatcagcgtggtttggtccggcctggaatggatcagtctggtttggcccaacctggtgcagatcagcgtggtttggtctggcctggaatggatcagtctggtttggcccaacctggtagagatcagcatggtttgatccagcctggcacaggtcagcatgatttggtccaatctggcacaggtcagggtgtcttggtacagcctggtgtagatcagcctggcatggtccaacctggcagatttcagcgtgctttggtgcagcctggtgcatatcagcctggcttggtccaacctggtgcagatcagattgatgtggtgcaacctggtgcagatcagcatggtttggtacaatctggtgcagatcagagtgatttggctcaacctggtgcagttcagcatggtttggtccaacctggagtagatcagcgtggtttggcacaacctcgtgcagatcatcagcgtggtttggtcccacctggtgcagatcagcgtggtttggtccaacctggtgcagatcagcatggtttggtccaacctggagtggatcagcatggtttggcacaacctggtgaagttcagcgtagtttggtgcaacctggtatagttcagcgtggtttggtgcaacctggtgcagttcagcgtggtttggtgcaacctggtgcagttcagcgtggtttggtccaacctggagtggatcagcgtggtttggttcaacctggtgcagttcagcgtggtttggtccaacctggtgcagttcagcatggtttggtccaacctggtgcagatcagcgtggtttggtccaacctggagtggatcagcgtggtttggtgcaacctggagtggatcagcgtggtttggtccaacctggaatggaccagcgtggtttgatccaacctggtgcagatcagcctggtttggtccagcctggtgcaggtcagctgggtatggtgcagcctggaataggtcagcaaggtatggtgcaacctcaggcagatccacatggcctggtacaacctggtgcctatcctcttggtttggtacaacctggtgcatatttgcatgatttatctcaatctgggacatatccacgtggtctggtgcagccaggaatggatcagtatggtttgagacaacctggtgcatatcagccaggcttgatagcaccaggcacaaagcttcgtggctcttcaacattccaggcagattctacaggttttatatcagtacgtccatatcaacatggtatggtacctcctggcagagaacaatacggccaggtgtcaccactcctagccagtcaaggtttggcatcacctggtatagatcgaaggagtttggtaccaccagaaacttatcagcaaggtttgatgcatcctggcacagaccagcacagcccaataccactgagtacaggtttgggatctacacacccagatcaacagcatgtggcatcacctggcccaggtgagcatgaccaggtatacccagatgcagctcagcatggccatgctttctctctctttgacagtcatgattcaatgtatcctggttatcgtggcccagggtatctaagtgctgatcagcatggccaggaaggtttggatccaaatagaacacgagcctcggaccgacatggaattcctgcccagaaggccccaggccaagatgtcactcttttcaggagtccagactccgtcgaccgagtcttatcagaagggagcgaagtctcgagtgaagtcctgagtgagcgacgcaattcactgcgtagaatgagttctagtttccccacggcagtggagacatttcatctgatgggagagctcagtagcctctatgtggggctaaaggagagtatgaaggatctggatgaggagcaggccggccaaaccgacttggagaagatccagttcctgctggcacagatggtcaaaaggaccatacctcctgaactgcaggagcagctgaagaccgtaaagacgctagccaaagaagtttggcaggagaaagcaaaagtggaaaggctgcagaggatcctggaaggggaagggaatcaagaagcagggaaggaactgaaagctggagagctgagattgcagctgggtgtcctcagagtcaccgtggctgacatagaaaaggagctggccgagttgagggagagccaagacaggggcaaggctgccatggaaaattctgtctctgaagcctccctttacctgcaggaccagttggacaagctcaggatgatcattgagagcatgctgacctcctcctccacgctcctgtccatgagcatggccccgcacaaggcccacaccttggctcctggccagatcgaccctgaggccacctgtccagcctgcagcctggatgtgagccatcaggtcagcacgctggtgcggcgctatgagcaactccaagacatggtcaacagcctggccgtctcccgaccctccaagaaggccaagctccagagacaggacgaggagctgctgggccgtgtgcagagtgccatcctgcaggtgcagggtgactgcgagaagctcaacatcaccaccagcaacctcatcgaggaccatcggcagaaacagaaggacattgctatgctgtaccagggtctggagaagctcgaaaaggaaaaggccaacagggagcacctggagatggagatcgatgtgaaagccgacaagagtgctctggccaccaaagtgagccgtgtccagtttgatgccaccacggagcagctgaaccacatgatgcaggagctggtggccaagatgagcgggcaggagcaggactggcagaagatgctggacaggctgctcacagagatggacaacaagctggaccgcctggagctggacccagtgaagcagttgctggaggatcggtggaaatcgctgcgacagcagctcagggagcgccccccactctaccaggcagacgaggcggctgccatgcggaggcagctcctggcacatttccactgcctctcatgtgaccggcccttggagacacctgtgactggacatgccatccccgtgacccccgcgggtccaggcctacctgggcaccattccatccgcccctacacggtgtttgaactggagcaggtccggcagcatagccgcaacctcaagctgggcagcgccttccctcggggtgacctggcgcagatggagcagagcgtggggcgcctgcgctccatgcactccaagatgctgatgaacattgagaaggtgcagatccacttcgggggctccaccaaggccagcagccagataatccgcgagctgctgcacgcccagtgcctgggctccccctgctacaaacgggtgacagatatggctgattacacctactcaactgtgccccggcgctgcgggggcagccacaccctcacctacccctaccaccgcagccgcccgcagcaccttccccggggcctgtatcctactgaagagatccagattgccatgaagcatgatgaggtggacatcttgggcctggatggccacatttacaagggacggatggacacaaggctgccaggcatcctccgaaaagacagctcagggacctcaaagcgcaagtcccagcagcccaggccccacgtgcacaggccgccatccctcagcagcaatggccagctgccctctcggccacagagcgcccagatttcggctggcaacacctcagaaagatagaccttcctccgagggccgtctctcccagccgaacacagcccacccgcccagctccgccgcggtggcaaacagggggctggagaggcacgtggacatgcctcctggggaggggctcgaggagcccacgcgggggccgcggtccagcaccgctcagtgagcggaggtgtaaataaacattcaggaggaa

SEQ ID NO: 137641 - DNA, 1500 bp, Homo sapiens
  Payload ID: 6952
  Gene Symbol: QRICH2
  Gene Name: glutamine rich 2
  ENST ID: ENST00000447564
  CDS Start-End: 1-1488
gactccgtcgaccgagtcttatcagaagggagcgaagtctcgagtgaagtcctgagtgagcgacgcaattcactgcgtagaatgagttctagtttccccacggcagtggagacatttcatctgatgggagagctcagtagcctctatgtggggctaaaggagagtatgaaggatctggatgaggagcaggccggccaaaccgacttggagaagatccagttcctgctggcacagatggtcaaaaggaccatacctcctgaactgcaggagcagctgaagaccgtaaagacgctagccaaagaagtttggcaggagaaagcaaaagtggaaaggctgcagaggatcctggaaggggaagggaatcaagaagcagggaaggaactgaaagctggagagctgagattgcagctgggtgtcctcagagtcaccgtggctgacatagaaaaggagctggccgagttgagggagagccaagacaggggcaaggctgccatggaaaattctgtctctgaagcctccctttacctgcaggaccagttggacaagctcaggatgatcattgagagcatgctgacctcctcctccacgctcctgtccatgagcatggccccgcacaaggcccacaccttggctcctggccagatcgaccctgaggccacctgtccagcctgcagcctggatgtgagccatcaggtcagcacgctggtgcggcgctatgagcaactccaagacatggtcaacagcctggccgtctcccgaccctccaagaaggccaagctccagagacaggacgaggagctgctgggccgtgtgcagagtgccatcctgcaggtgcagggtgactgcgagaagctcaacatcaccaccagcaacctcatcgaggaccatcggcagaaacagaaggacattgctatgctgtaccagggtctggagaagctcgaaaaggaaaaggccaacagggagcacctggagatggagatcgatgtgaaagccgacaagagtgctctggccaccaaagtgagccgtgtccagtttgatgccaccacggagcagctgaaccacatgatgcaggagctggtggccaagatgagcgggcaggagcaggactggcagaagatgctggacaggctgctcacagagatggacaacaaggctgccaggcatcctccgaaaagacagctcagggacctcaaagcgcaagtcccagcagcccaggccccacgtgcacaggccgccatccctcagcagcaatggccagctgccctctcggccacagagcgcccagatttcggctggcaacacctcagaaagatagaccttcctccgagggccgtctctcccagccgaacacagcccacccgcccagctccgccgcggtggcaaacagggggctggagaggcacgtggacatgcctcctggggaggggctcgaggagcccacgcgggggccgcggtccagcaccgctcagtgagcggaggtgtaaataaacattcaggagg

SEQ ID NO: 137642 - DNA, 2253 bp, Homo sapiens
  Payload ID: 6952
  Gene Symbol: QRICH2
  Gene Name: glutamine rich 2
  ENST ID: ENST00000524722
  CDS Start-End: 66-392
tagagtggccggaggagcaggaggtgggcgtgcgggcgttcgatagggtgcggactgggagtatcatgaaggacgccgccgaggagctcagctttgccagggtacttttacagcgggttgatgaactagagaagctattcaaagatcgggagcaattcctggaactagtcagccggaagctgagtttggttcctggtgcagaagaagtcaccatggtcacctgggaagagctggagcaggcgattacggacggctggagagcctcacaagcggctggagtgcagtggtgtgatctcggctcactgcaaccttcccctctggggctcaagcaatcctcctgcctcagcctccccggtagttgggaccacagtcaaaaggaccatacctcctgaactgcaggagcagctgaagaccgtaaagacgctagccaaagaagtttggcaggagaaagcaaaagtggaaaggctgcagaggatcctggaaggggaagggaatcaagaagcagggaaggaactgaaagctggagagctgagattgcagctgggtgtcctcagagtcaccgtggctgacatagaaaaggagctggccgagttgagggagagccaagacaggggcaaggctgccatggaaaattctgtctctgaagcctccctttacctgcaggaccagttggacaagctcaggatgatcattgagagcatgctgacctcctcctccacgctcctgtccatgagcatggccccgcacaaggcccacaccttggctcctggccagatcgaccctgaggccacctgtccagcctgcagcctggatgtgagccatcaggtcagcacgctggtgcggcgctatgagcaactccaagacatggtcaacagcctggccgtctcccgaccctccaagaaggccaagctccagagacaggacgaggagctgctgggccgtgtgcagagtgccatcctgcaggtgcagggtgactgcgagaagctcaacatcaccaccagcaacctcatcgaggaccatcggcagaaacagaaggacattgctatgctgtaccagggtctggagaagctcgaaaaggaaaaggccaacagggagcacctggagatggagatcgatgtgaaagccgacaagagtgctctggccaccaaagtgagccgtgtccagtttgatgccaccacggagcagctgaaccacatgatgcaggagctggtggccaagatgagcgggcaggagcaggactggcagaagatgctggacaggctgctcacagagatggacaacaagctggaccgcctggagctggacccagtgaagcagttgctggaggatcggtggaaatcgctgcgacagcagctcagggagcgccccccactctaccaggcagacgaggcggctgccatgcggaggcagctcctggcacatttccactgcctctcatgtgaccggcccttggagacacctgtgactggacatgccatccccgtgacccccgcgggtccaggcctacctgggcaccattccatccgcccctacacggtgtttgaactggagcaggtccggcagcatagccgcaacctcaagctgggcagcgccttccctcggggtgacctggcgcagatggagcagagcgtggggcgcctgcgctccatgcactccaagatgctgatgaacattgagaaggtgcagatccacttcgggggctccaccaaggccagcagccagataatccgcgagctgctgcacgcccagtgcctgggctccccctgctacaaacgggtgacagatatggctgattacacctactcaactgtgccccggcgctgcgggggcagccacaccctcacctacccctaccaccgcagccgcccgcagcaccttccccggggcctgtatcctactgaagagatccagattgccatgaagcatgatgaggtggacatcttgggcctggatggccacatttacaagggacggatggacacaaggctgccaggcatcctccgaaaagacagctcagggacctcaaagcgcaagtcccagcagcccaggccccacgtgcacaggccgccatccctcagcagcaatggccagctgccctctcggccacagagcgcccagatttcggctggcaacacctcagaaagatagaccttcctccgagggccgtctctcccagccgaacacagcccacccgcccagctccgccgcggtggcaaacagggggctggagaggcacgtggacatgcctcctgg

SEQ ID NO: 137643 - DNA, 839 bp, Homo sapiens
  Payload ID: 6952
  Gene Symbol: QRICH2
  Gene Name: glutamine rich 2
  ENST ID: ENST00000532549
  CDS Start-End: 1-839
ccaagatgagcgggcaggagcaggactggcagaagatgctggacaggctgctcacagagatggacaacaagctggaccgcctggagctggacccagtgaagcagttgctggaggatcggtggaaatcgctgcgacagcagctcagggagcgccccccactctaccaggcagacgaggcggctgccatgcggaggcagctcctggcacatttccactgcctctcatgtgaccggcccttggagacacctgtgactggacatgccatccccgtgacccccgcgggtccaggcctacctgggcaccattccatccgcccctacacggtgtttgaactggagcaggtccggcagcatagccgcaacctcaagctgggcagcgccttccctcggggtgacctggcgcagatggagcagagcgtggggcgcctgcgctccatgcactccaagatgctgatgaacattgagaaggtgcagatccacttcgggggctccaccaaggccagcagccagataatccgcgagctgctgcacgcccagtgcctgggctccccctgctacaaacgcatgatgaggtggacatcttgggcctggatggccacatttacaagggacggatggacacaaggctgccaggcatcctccgaaaagacagctcagggacctcaaagcgcaagtcccagcagcccaggccccacgtgcacaggccgccatccctcagcagcaatggccagctgccctctcggccacagagcgcccagatttcggctggcaacacctcagaaagatagaccttcctccgagggccgtctctcccagccgaacacagcccacccgcccagc

SEQ ID NO: 137644 - DNA, 8703 bp, Homo sapiens
  Payload ID: 6953
  Gene Symbol: GFPT1
  Gene Name: glutamine--fructose-6-phosphate transaminase 1
  Uniprot ID: Q06210
  ENST ID: ENST00000357308
  CDS Start-End: 184-2283
ggttgctggcggagcccgggaggcggagaaggctgtcgttgccttggccgtcgcatccccgagggagtcgtgtcggcgccaccccggcccccgagcccgcagattgcccaccgaagctcgtgtgtgcacccccgatcccgccagccactcgcccctggcctcgcgggccgtgtctccggcatcatgtgtggtatatttgcttacttaaactaccatgttcctcgaacgagacgagaaatcctggagaccctaatcaaaggccttcagagactggagtacagaggatatgattctgctggtgtgggatttgatggaggcaatgataaagattgggaagccaatgcctgcaaaatccagcttattaagaagaaaggaaaagttaaggcactggatgaagaagttcacaagcaacaagatatggatttggatatagaatttgatgtacaccttggaatagctcatacccgttgggcaacacatggagaacccagtcctgtcaatagccacccccagcgctctgataaaaataatgaatttatcgttattcacaatggaatcatcaccaactacaaagacttgaaaaagtttttggaaagcaaaggctatgacttcgaatctgaaacagacacagagacaattgccaagctcgttaagtatatgtatgacaatcgggaaagtcaagataccagctttactaccttggtggagagagttatccaacaattggaaggtgcttttgcacttgtgtttaaaagtgttcattttcccgggcaagcagttggcacaaggcgaggtagccctctgttgattggtgtacggagtgaacataaactttctactgatcacattcctatactctacagaacagctaggactcagattggatcaaaattcacacggtggggatcacagggagaaagaggcaaagacaagaaaggaagctgcaatctctctcgtgtggacagcacaacctgccttttcccggtggaagaaaaagcagtggagtattactttgcttctgatgcaagtgctgtcatagaacacaccaatcgcgtcatctttctggaagatgatgatgttgcagcagtagtggatggacgtctttctatccatcgaattaaacgaactgcaggagatcaccccggacgagctgtgcaaacactccagatggaactccagcagatcatgaagggcaacttcagttcatttatgcagaaggaaatatttgagcagccagagtctgtcgtgaacacaatgagaggaagagtcaactttgatgactatactgtgaatttgggtggtttgaaggatcacataaaggagatccagagatgccggcgtttgattcttattgcttgtggaacaagttaccatgctggtgtagcaacacgtcaagttcttgaggagctgactgagttgcctgtgatggtggaactagcaagtgacttcctggacagaaacacaccagtctttcgagatgatgtttgctttttccttagtcaatcaggtgagacagcagatactttgatgggtcttcgttactgtaaggagagaggagctttaactgtggggatcacaaacacagttggcagttccatatcacgggagacagattgtggagttcatattaatgctggtcctgagattggtgtggccagtacaaaggcttataccagccagtttgtatcccttgtgatgtttgcccttatgatgtgtgatgatcggatctccatgcaagaaagacgcaaagagatcatgcttggattgaaacggctgcctgatttgattaaggaagtactgagcatggatgacgaaattcagaaactagcaacagaactttatcatcagaagtcagttctgataatgggacgaggctatcattatgctacttgtcttgaaggggcactgaaaatcaaagaaattacttatatgcactctgaaggcatccttgctggtgaattgaaacatggccctctggctttggtggataaattgatgcctgtgatcatgatcatcatgagagatcacacttatgccaagtgtcagaatgctcttcagcaagtggttgctcggcaggggcggcctgtggtaatttgtgataaggaggatactgagaccattaagaacacaaaaagaacgatcaaggtgccccactcagtggactgcttgcagggcattctcagcgtgatccctttacagttgctggctttccaccttgctgtgctgagaggctatgatgttgatttcccacggaatcttgccaaatctgtgactgtagagtgaggaatatctatacaaaatgtacgaaactgtatgattaagcaacacaagacaccttttgtatttaaaaccttgatttaaaatatcaccccttgaagcctttttttagtaaatccttatttatatatcagttataattattccactcaatatgtgatttttgtgaagttacctcttacattttcccagtaatttgtggaggactttgaataatggaatctatattggaatctgtatcagaaagattctagctattattttctttaaagaatgctgggtgttgcatttctggaccctccacttcaatctgagaagacaatatgtttctaaaaattggtacttgtttcaccatacttcattcagaccagtgaaagagtagtgcatttaattggagtatctaaagccagtggcagtgtatgctcatacttggacagttagggaagggtttgccaagttttaagagaagatgtgatttattttgaaatttgtttctgttttgtttttaaatcaaactgtaaaacttaaaactgaaaaattttattggtaggatttatatctaagtttggttagccttagtttctcagacttgttgtctattatctgtaggtggaagaaatttaggaagcgaaatattacagtagtgcattggtgggtctcaatccttaacatatttgcacaattttatagcacaaactttaaattcaagctgctttggacaactgacaatatgattttaaatttgaagatgggatgtgtacatgttgggtatcctactactttgtgttttcatctcctaaaagtggtttttatttccttgtatctgtagtcttttattttttaaatgactgctgaatgacatattttatcttgttctttaaaatcacaacacagagctgctattaaattaatattgatatattcagtattctcttcaactttgtcacgaggaagaatttcctgtagttaattttaactttccttcattacattgttgcataaaactagtcccttagtgccagtttggaagttacttgcaattgtttggaagatttgcaggtcgctgacctcatcatttcactctaagtatatgtggtaggctaagctcagaaaaaggtatgtatgctttacactgataggcaccaaatttagtattgtatcctaagtatttttcctcttctgtattttctgtgctctacccctgaaatatatttaggaataaagaagatataaataaagtgatattggggtatgttcagcttgtaagtgtcagaaatggaagttgacaatttggattaaaatatttaaagtagaatgttattatttgatacccccaaaattgtgagtaataatttcttaatggagcttttctggccagatcttcagggctataggagagtgtgtttgtttttggtgaagtccttctttttcaaaggtttttacttttaaattgtgaagataagctatttagcacaattatttaagtaagctgttttttcctttcttttctttcttttcttgttttaacttctgggtgaggttaagattttctaatagttattgttgttgccagagaagcatagaattctgcttgtgtcttagggttagagaaagatttgttatattttgaggtaatttggaaggactttcatacatggtgactagaaacctgatctttttaagaataaaatagggtcactatttacattatatataatatatggctattatagctatattaatctactttaattgtttctaagattattttgtgtaagtcagctagcgtgtgtatagtgtcatttcttatgttttgtatattaacgttttacaaacacaatttgtgtgggtttgtagcatttcttatagtttaaagtatgattcagcattctaagttaaaactaatatgtgaagtcagtcattagtctgcataatctctgtctccctctgtgtgtgtctttctataaagcacatgtgtacacacacacacacaaatatactgaaagctagggtaagttctaaactgaatatcaaaaaccaaaatcaagaacaaagaagtgatattttccaaacaaacatggattctctgccgggtgcagtggctcagcctgtaataccagcctccactttgggagtctgaggtgggagtattgcttgagctcaagagttggagaacagcctgggcaacatggtgagacctggtctttacaaaaatttttttggccggacgcagtggctcacacctgtaatcccagcactttgggaggccgaggcaggttgatcatgaggtcaagagatcgagaccatcctggccaacatggtgaaaccccgtctttactaaaaatacaaaaattagctgggagtggtggcgtgcgcctgtagtcccaactacttgggaggctgaggcaggagaatcgcttgaacccaggaggcggaggttgcagtgaggcgagatcacgccactacactccagcctggcgacagagcaagactctctcaaaaaaaaaaaaaaaaaattttttttttaaatgggctgggcatggtggcttgtgcctgtagtctcagcaacttgggaggcttaagtagtaggatcgcttgagcctgggaggttgaggctgcagtgagctgtgattgtgccactgtgcttcagcttgagtgacagagtgagaccctcctgactcaaaacaaaaaacatggtttctcctctctctcctgtcttcttactctctatcccatttgatgtagtgatttttaaatgcttttgtaagttaattcttaacacaaaagagacattgtaatgaggcacaccactaaagtgagcatgcccaattaaaaccagtgtaatataggataagaaaatctgatttttcaaaaaagatactctacataaagaatccttcatataaaaagttctttcttgtagtacatttaaagttttaattcactcatgtataactgagagttcctttgagccctttttaggcagggaggcatgtctgtcatctagcgtgtggcccagtaagtgattattacattggaatcagtttttcagtcttttaaaataaattctgtgccataagaataaaagataaagagaaaaattaatgttaactatttttagcttattataactatgtcaacaagtgtttattaatacctattatgggaaagtcactgtggttggcattgaaaattacatcatctttaaagcagtatttgtccccagatggactcatcactagcaaagactaggttcattggaaggcatagggtgagagaatgggaagatgaagtggaggcgggttgttaaagtgctgtcagtgagtgattttgtctacttgaataatggtccatgtttgggggcatattgtgtttcataagaagtgaaaggtatttgcaaagtaagctacaaatgacccataaatctgttaacaacagtccttaatatgcaaagatgaaaaacaagcattactgctacccaaagggaactggtgcttggtgatgtgcagatggggctgttggttaagagagctattacaggttttctctcttaggtttcataggaggtagttactgagatgagattgttttatctttttgaatacagatctcttgtcttgagttagttctgaggatgggagtaataaaggagttttttgtttttttgtttgtttgtttgttttggctccttagtaatactcctctgacatttatttctattattcttcaaagaaaggaaaccaactgaaatgtttgctttaacaaacattttaataagttctctgggtttttttttccccttttaaaaaaattagcatataccatagcaataaaagaactaatgttaactattgtatgctacaacttaagtgatttttctaaagaagcacaatgtcattgaaagtattattgaaaaggatcatagtcacattgaatttgtgaaggccaaagaaattgaagggagtgatattttcattttatgatattcacatatttagtaaattttgtgtacaagaataccaggcagagtgttttacccatggaaacaggtttcagattactttatttttactgttagagtctcaagtttagaaatgctaacacttaaatcagtttttttctcactatacttgaagattgttaatattttgatatcttcctagcttgatgaatttaaacatatcttcagatctgtgacagtgacagccaataggactgataatattagcttcaaaccaataatatccagggttaaaataaaaatcatagtgaaagtacgattgtaaaattatgctatattaacttttaagtctgtaataacttgacatcaaaatgttatgtaattaccataaataatggctagcgagaacatctttggaaattctcaaattacctttcttactacactgtttgcagaatgaatgtagaaatgatcctgttagctttctgaatgttctgtggttgaatgtgtttttgcttaaataaagcttttggtatttgtttaaattacacttcttgagaagtggaaattttaggatcatctttgctttgtttcagttttgtgatttttgaaatgaatgtttagtttactgagccagttggtcatttcttcctcatgtcgttaagtccagtgagtaagcctgaactgtgaataaattaccaaaaacttgcttagaatttcattttgaagcaatttgctaatatttgaagtgtatacacatttgtagttatgttagaaattgtattgtactaagaatgtaatcaatgtctactttagttgtaaacatttctgatgtcaaaactttattcattactgttgattttaagaataagaaatcactgcctaaatattaccaaaagccactgtctctacccgaacttcccagtttgggaaagaatcgttagataaaacaaaggctctgccctttctgataccaaactccacagatactttctcacatcttttaaaacattttgcaataacatattgtttataggaagtttacggggtatgcaatgattaaaacttttaagtgaattgatagttgcaaaagaaaggataatatttaaggtcagtgagtagcaagacaatctaaagtttctgtaatatctggctctctgttaattatagagcaaagtttcccttacagaatccttttatgaacagcaagctagagtctatccctagtggttatagcacctgctgcgtttttcaggagacagttaggccagggtgatttgaatggatagatgtgctgttttgcctgcttgtagaattcagcccagtctttggtctctctctctctctccctcctccacctctccctctctcttcttctgcaccagagcctaaggctgcgccaccaagatgcgtcattttttccagaggcttcttttttttttttttgagatggagttttgctctgttgcccaggctggcatgcagtgctgcaatcttggctgactgcaacttccacctcccgtgttcacacgagtcttttgcctcagcctctggattagctgggattacaggcacgtgccaccatgcctagctaatttttgtgtttttagtagagacggggtttcaccatgttggccaggctagtctcaaactcctgaccttaagtgatctgcccgccttggcctcccaaagtgctgggattacaggcatgagtcaccgtgtcctgcccagacatatcaaatttgacaggtattgtataccctttggatctttaggaattaatttttgcctctgtcactcagctttgtatattttgaaatggagataagtatagggaggtcttggaaggaaaattgccagaattcccaaaccatgtaacactcattgagaattccagatccattatatctaaagggcaagtgaaggaaacagtattgtgaactgggtataactccttggttcttaactagtacattcttaatctgtgagacccaaaggttgataaacaataatttaagattgtacagtactctaaacgtctgcaaaggtctagatgttatcagtatcactagtttttatttctgccagtagctcccttttaggttacattgttgtcctctttccagtgtcgcatctgtcattggtttttcactatggcaagttcattaaaaagcttgctccattgttatcttcaagtaatgcccataaggagatggaagatatctgagacaattaaggctttagcttctaggcaagagaaataacgttgcattaaatttcaagtttctttctgctagacttgaatgtgtctagccactctaatttatgggggcttttggttttttcctattgtactttgtatgtagaattgttttgaaatatcaagcatatttactttgaatttgaactctttcttaattttgtatttatcctttgaataaaatgtaaatccaatatttattatt

SEQ ID NO: 137645 - DNA, 8632 bp, Homo sapiens
  Payload ID: 6953
  Gene Symbol: GFPT1
  Gene Name: glutamine--fructose-6-phosphate transaminase 1
  Uniprot ID: Q06210
  ENST ID: ENST00000361060
  CDS Start-End: 178-2223
tggcggagcccgggaggcggagaaggctgtcgttgccttggccgtcgcatccccgagggagtcgtgtcggcgccaccccggcccccgagcccgcagattgcccaccgaagctcgtgtgtgcacccccgatcccgccagccactcgcccctggcctcgcgggccgtgtctccggcatcatgtgtggtatatttgcttacttaaactaccatgttcctcgaacgagacgagaaatcctggagaccctaatcaaaggccttcagagactggagtacagaggatatgattctgctggtgtgggatttgatggaggcaatgataaagattgggaagccaatgcctgcaaaatccagcttattaagaagaaaggaaaagttaaggcactggatgaagaagttcacaagcaacaagatatggatttggatatagaatttgatgtacaccttggaatagctcatacccgttgggcaacacatggagaacccagtcctgtcaatagccacccccagcgctctgataaaaataatgaatttatcgttattcacaatggaatcatcaccaactacaaagacttgaaaaagtttttggaaagcaaaggctatgacttcgaatctgaaacagacacagagacaattgccaagctcgttaagtatatgtatgacaatcgggaaagtcaagataccagctttactaccttggtggagagagttatccaacaattggaaggtgcttttgcacttgtgtttaaaagtgttcattttcccgggcaagcagttggcacaaggcgaggtagccctctgttgattggtgtacggagtgaacataaactttctactgatcacattcctatactctacagaacaggcaaagacaagaaaggaagctgcaatctctctcgtgtggacagcacaacctgccttttcccggtggaagaaaaagcagtggagtattactttgcttctgatgcaagtgctgtcatagaacacaccaatcgcgtcatctttctggaagatgatgatgttgcagcagtagtggatggacgtctttctatccatcgaattaaacgaactgcaggagatcaccccggacgagctgtgcaaacactccagatggaactccagcagatcatgaagggcaacttcagttcatttatgcagaaggaaatatttgagcagccagagtctgtcgtgaacacaatgagaggaagagtcaactttgatgactatactgtgaatttgggtggtttgaaggatcacataaaggagatccagagatgccggcgtttgattcttattgcttgtggaacaagttaccatgctggtgtagcaacacgtcaagttcttgaggagctgactgagttgcctgtgatggtggaactagcaagtgacttcctggacagaaacacaccagtctttcgagatgatgtttgctttttccttagtcaatcaggtgagacagcagatactttgatgggtcttcgttactgtaaggagagaggagctttaactgtggggatcacaaacacagttggcagttccatatcacgggagacagattgtggagttcatattaatgctggtcctgagattggtgtggccagtacaaaggcttataccagccagtttgtatcccttgtgatgtttgcccttatgatgtgtgatgatcggatctccatgcaagaaagacgcaaagagatcatgcttggattgaaacggctgcctgatttgattaaggaagtactgagcatggatgacgaaattcagaaactagcaacagaactttatcatcagaagtcagttctgataatgggacgaggctatcattatgctacttgtcttgaaggggcactgaaaatcaaagaaattacttatatgcactctgaaggcatccttgctggtgaattgaaacatggccctctggctttggtggataaattgatgcctgtgatcatgatcatcatgagagatcacacttatgccaagtgtcagaatgctcttcagcaagtggttgctcggcaggggcggcctgtggtaatttgtgataaggaggatactgagaccattaagaacacaaaaagaacgatcaaggtgccccactcagtggactgcttgcagggcattctcagcgtgatccctttacagttgctggctttccaccttgctgtgctgagaggctatgatgttgatttcccacggaatcttgccaaatctgtgactgtagagtgaggaatatctatacaaaatgtacgaaactgtatgattaagcaacacaagacaccttttgtatttaaaaccttgatttaaaatatcaccccttgaagcctttttttagtaaatccttatttatatatcagttataattattccactcaatatgtgatttttgtgaagttacctcttacattttcccagtaatttgtggaggactttgaataatggaatctatattggaatctgtatcagaaagattctagctattattttctttaaagaatgctgggtgttgcatttctggaccctccacttcaatctgagaagacaatatgtttctaaaaattggtacttgtttcaccatacttcattcagaccagtgaaagagtagtgcatttaattggagtatctaaagccagtggcagtgtatgctcatacttggacagttagggaagggtttgccaagttttaagagaagatgtgatttattttgaaatttgtttctgttttgtttttaaatcaaactgtaaaacttaaaactgaaaaattttattggtaggatttatatctaagtttggttagccttagtttctcagacttgttgtctattatctgtaggtggaagaaatttaggaagcgaaatattacagtagtgcattggtgggtctcaatccttaacatatttgcacaattttatagcacaaactttaaattcaagctgctttggacaactgacaatatgattttaaatttgaagatgggatgtgtacatgttgggtatcctactactttgtgttttcatctcctaaaagtggtttttatttccttgtatctgtagtcttttattttttaaatgactgctgaatgacatattttatcttgttctttaaaatcacaacacagagctgctattaaattaatattgatatattcagtattctcttcaactttgtcacgaggaagaatttcctgtagttaattttaactttccttcattacattgttgcataaaactagtcccttagtgccagtttggaagttacttgcaattgtttggaagatttgcaggtcgctgacctcatcatttcactctaagtatatgtggtaggctaagctcagaaaaaggtatgtatgctttacactgataggcaccaaatttagtattgtatcctaagtatttttcctcttctgtattttctgtgctctacccctgaaatatatttaggaataaagaagatataaataaagtgatattggggtatgttcagcttgtaagtgtcagaaatggaagttgacaatttggattaaaatatttaaagtagaatgttattatttgatacccccaaaattgtgagtaataatttcttaatggagcttttctggccagatcttcagggctataggagagtgtgtttgtttttggtgaagtccttctttttcaaaggtttttacttttaaattgtgaagataagctatttagcacaattatttaagtaagctgttttttcctttcttttctttcttttcttgttttaacttctgggtgaggttaagattttctaatagttattgttgttgccagagaagcatagaattctgcttgtgtcttagggttagagaaagatttgttatattttgaggtaatttggaaggactttcatacatggtgactagaaacctgatctttttaagaataaaatagggtcactatttacattatatataatatatggctattatagctatattaatctactttaattgtttctaagattattttgtgtaagtcagctagcgtgtgtatagtgtcatttcttatgttttgtatattaacgttttacaaacacaatttgtgtgggtttgtagcatttcttatagtttaaagtatgattcagcattctaagttaaaactaatatgtgaagtcagtcattagtctgcataatctctgtctccctctgtgtgtgtctttctataaagcacatgtgtacacacacacacacaaatatactgaaagctagggtaagttctaaactgaatatcaaaaaccaaaatcaagaacaaagaagtgatattttccaaacaaacatggattctctgccgggtgcagtggctcagcctgtaataccagcctccactttgggagtctgaggtgggagtattgcttgagctcaagagttggagaacagcctgggcaacatggtgagacctggtctttacaaaaatttttttggccggacgcagtggctcacacctgtaatcccagcactttgggaggccgaggcaggttgatcatgaggtcaagagatcgagaccatcctggccaacatggtgaaaccccgtctttactaaaaatacaaaaattagctgggagtggtggcgtgcgcctgtagtcccaactacttgggaggctgaggcaggagaatcgcttgaacccaggaggcggaggttgcagtgaggcgagatcacgccactacactccagcctggcgacagagcaagactctctcaaaaaaaaaaaaaaaaaattttttttttaaatgggctgggcatggtggcttgtgcctgtagtctcagcaacttgggaggcttaagtagtaggatcgcttgagcctgggaggttgaggctgcagtgagctgtgattgtgccactgtgcttcagcttgagtgacagagtgagaccctcctgactcaaaacaaaaaacatggtttctcctctctctcctgtcttcttactctctatcccatttgatgtagtgatttttaaatgcttttgtaagttaattcttaacacaaaagagacattgtaatgaggcacaccactaaagtgagcatgcccaattaaaaccagtgtaatataggataagaaaatctgatttttcaaaaaagatactctacataaagaatccttcatataaaaagttctttcttgtagtacatttaaagttttaattcactcatgtataactgagagttcctttgagccctttttaggcagggaggcatgtctgtcatctagcgtgtggcccagtaagtgattattacattggaatcagtttttcagtcttttaaaataaattctgtgccataagaataaaagataaagagaaaaattaatgttaactatttttagcttattataactatgtcaacaagtgtttattaatacctattatgggaaagtcactgtggttggcattgaaaattacatcatctttaaagcagtatttgtccccagatggactcatcactagcaaagactaggttcattggaaggcatagggtgagagaatgggaagatgaagtggaggcgggttgttaaagtgctgtcagtgagtgattttgtctacttgaataatggtccatgtttgggggcatattgtgtttcataagaagtgaaaggtatttgcaaagtaagctacaaatgacccataaatctgttaacaacagtccttaatatgcaaagatgaaaaacaagcattactgctacccaaagggaactggtgcttggtgatgtgcagatggggctgttggttaagagagctattacaggttttctctcttaggtttcataggaggtagttactgagatgagattgttttatctttttgaatacagatctcttgtcttgagttagttctgaggatgggagtaataaaggagttttttgtttttttgtttgtttgtttgttttggctccttagtaatactcctctgacatttatttctattattcttcaaagaaaggaaaccaactgaaatgtttgctttaacaaacattttaataagttctctgggtttttttttccccttttaaaaaaattagcatataccatagcaataaaagaactaatgttaactattgtatgctacaacttaagtgatttttctaaagaagcacaatgtcattgaaagtattattgaaaaggatcatagtcacattgaatttgtgaaggccaaagaaattgaagggagtgatattttcattttatgatattcacatatttagtaaattttgtgtacaagaataccaggcagagtgttttacccatggaaacaggtttcagattactttatttttactgttagagtctcaagtttagaaatgctaacacttaaatcagtttttttctcactatacttgaagattgttaatattttgatatcttcctagcttgatgaatttaaacatatcttcagatctgtgacagtgacagccaataggactgataatattagcttcaaaccaataatatccagggttaaaataaaaatcatagtgaaagtacgattgtaaaattatgctatattaacttttaagtctgtaataacttgacatcaaaatgttatgtaattaccataaataatggctagcgagaacatctttggaaattctcaaattacctttcttactacactgtttgcagaatgaatgtagaaatgatcctgttagctttctgaatgttctgtggttgaatgtgtttttgcttaaataaagcttttggtatttgtttaaattacacttcttgagaagtggaaattttaggatcatctttgctttgtttcagttttgtgatttttgaaatgaatgtttagtttactgagccagttggtcatttcttcctcatgtcgttaagtccagtgagtaagcctgaactgtgaataaattaccaaaaacttgcttagaatttcattttgaagcaatttgctaatatttgaagtgtatacacatttgtagttatgttagaaattgtattgtactaagaatgtaatcaatgtctactttagttgtaaacatttctgatgtcaaaactttattcattactgttgattttaagaataagaaatcactgcctaaatattaccaaaagccactgtctctacccgaacttcccagtttgggaaagaatcgttagataaaacaaaggctctgccctttctgataccaaactccacagatactttctcacatcttttaaaacattttgcaataacatattgtttataggaagtttacggggtatgcaatgattaaaacttttaagtgaattgatagttgcaaaagaaaggataatatttaaggtcagtgagtagcaagacaatctaaagtttctgtaatatctggctctctgttaattatagagcaaagtttcccttacagaatccttttatgaacagcaagctagagtctatccctagtggttatagcacctgctgcgtttttcaggagacagttaggccagggtgatttgaatggatagatgtgctgttttgcctgcttgtagaattcagcccagtctttggtctctctctctctctccctcctccacctctccctctctcttcttctgcaccagagcctaaggctgcgccaccaagatgcgtcattttttccagaggcttcttttttttttttttgagatggagttttgctctgttgcccaggctggcatgcagtgctgcaatcttggctgactgcaacttccacctcccgtgttcacacgagtcttttgcctcagcctctggattagctgggattacaggcacgtgccaccatgcctagctaatttttgtgtttttagtagagacggggtttcaccatgttggccaggctagtctcaaactcctgaccttaagtgatctgcccgccttggcctcccaaagtgctgggattacaggcatgagtcaccgtgtcctgcccagacatatcaaatttgacaggtattgtataccctttggatctttaggaattaatttttgcctctgtcactcagctttgtatattttgaaatggagataagtatagggaggtcttggaaggaaaattgccagaattcccaaaccatgtaacactcattgagaattccagatccattatatctaaagggcaagtgaaggaaacagtattgtgaactgggtataactccttggttcttaactagtacattcttaatctgtgagacccaaaggttgataaacaataatttaagattgtacagtactctaaacgtctgcaaaggtctagatgttatcagtatcactagtttttatttctgccagtagctcccttttaggttacattgttgtcctctttccagtgtcgcatctgtcattggtttttcactatggcaagttcattaaaaagcttgctccattgttatcttcaagtaatgcccataaggagatggaagatatctgagacaattaaggctttagcttctaggcaagagaaataacgttgcattaaatttcaagtttctttctgctagacttgaatgtgtctagccactctaatttatgggggcttttggttttttcctattgtactttgtatgtagaattgttttgaaatatcaagcatatttactttgaatttgaactctttcttaattttgtatttatcctttgaataaaatgtaaatccaa

SEQ ID NO: 137646 - DNA, 3093 bp, Homo sapiens
  Payload ID: 6954
  Gene Symbol: GFPT2
  Gene Name: glutamine-fructose-6-phosphate transaminase 2
  Uniprot ID: O94808
  ENST ID: ENST00000253778
  CDS Start-End: 171-2219
cgccctctcggagggctccgggttataagggctggaggccgagcggacgggagctggagcccgcggagcccacggagcccacggagcccacggaggagcccacggaggagccccagcgtccgaacgggcagaccccctcgagccgcgaaggagcccgagaagcagccacgatgtgcggaatctttgcctacatgaactacagagtcccccggacgaggaaggagatcttcgaaaccctcatcaagggcctgcagcggctggagtacagaggctacgactcggcaggtgtggcgatcgatgggaataatcacgaagtcaaagaaagacacattcagctggtcaagaaaagggggaaagtcaaggctctcgatgaagaactttacaaacaagacagcatggacttaaaagtggagtttgagacacacttcggcattgcccacacgcgctgggccacccacggggtccccagtgctgtcaacagccaccctcagcgctcagacaaaggcaacgaatttgttgtcatccacaatgggatcatcacaaattacaaagatctgaggaaatttctggaaagcaaaggctacgagtttgagtcagaaacagatacagagaccatcgccaagctgattaaatatgtgttcgacaacagagaaactgaggacattacgttttcaacgttggtcgagagagtcattcagcagttggaaggtgcattcgcgctggttttcaagagtgtccactacccaggagaagccgttgccacacggagaggcagccccctgctcatcggagtccggagcaaatacaagctctccacagaacagatccctatcttatacaggacgtgcactctggagaatgtgaagaatatctgtaagacacggatgaagaggctggacagctccgcctgcctgcatgctgtgggcgacaaggccgtggaattcttctttgcttctgatgcaagcgctatcatagagcacaccaaccgggtcatcttcctggaggacgatgacatcgccgcagtggctgatgggaaactctccattcaccgggtcaagcgctcggccagtgatgacccatctcgagccatccagaccttgcagatggaactgcagcaaatcatgaaaggtaacttcagtgcgtttatgcagaaggagatcttcgaacagccagaatcagttttcaatactatgagaggtcgggtgaattttgaaaccaacacagtgctcctgggtggcttgaaggaccacttgaaggagattcgacgatgccgacggctcatcgtgattggctgtggaaccagctaccacgctgccgtggctacgcggcaagttttggaggaactgactgagcttcctgtgatggttgaacttgctagtgattttctggacaggaacacacctgtgttcagggatgacgtttgctttttcatcagccagtcaggcgagaccgcggacaccctcctggcgctgcgctactgtaaggaccgcggcgctctcaccgtgggcgtcaccaacaccgtgggcagctccatctctcgcgagaccgactgcggcgtccacatcaacgcagggccggagatcggcgtggccagcaccaaggcttataccagtcagttcatctctctggtgatgtttggtttgatgatgtctgaagaccgaatttcactacaaaacaggaggcaagagatcatccgtggcttgagatctttacctgagctgatcaaggaagtgctgtctctggaggagaagatccacgacttggccctggagctctacacgcagagatcgctgctggtgatggggcggggctacaactatgccacctgcctggaaggagccctgaaaattaaagagataacctacatgcactcagaaggcatcctggctggggagctgaagcacgggcccctggcactgattgacaagcagatgcccgtcatcatggtcattatgaaggatccttgcttcgccaaatgccagaacgccctgcagcaagtcacggcccgccagggtcgccccattatactgtgctccaaggacgatactgaaagttccaagtttgcgtataagacaattgagctgccccacactgtggactgcctccagggcatcctgagcgtgattccgctgcagctgctgtccttccacctggctgttctccgaggatatgacgttgacttccccagaaatctggccaagtctgtaactgtggaatgaggctgagaccgtgacaagaccatcaccacctttcatctgattccagacctgtcccaacagcagggatgctacatgggaagagaagtggacatcccacatgttctgcgtgctcctgtagagcttgacagcttccacgtgccttctacccaagtgcttttgcttacagcagatactgtttctctgtgtcctgaagtcgccagaggagaagggaatcattgtttacacatggggatcagagcagacttctccactactgtgcaatagagatacagctctcttcagagtaactgtgaaccttttataaccaacactagagttagttttaaaagacaagatatttataatgacgactgtatagcttttaagttatttttctagtatgtggctttctgtagccgtggtaacggccaaactgttcatcctagctacccatgctctgtgtccaggcttgctcctggcaggtggcattcatctcagatgtgagcacaaggcattggccctctggactcctttctccttttctttcctctctaggctgctcctgaatcctgttctctgacatccgtggagcccctcctgcatccacctatgcctcctataagtccagttgaaatctcagcctccttcaacattttcttctcgtgtgtggcccacatccctccacttctccaacttctgtttaatctgatcacggctctttttaagccctggcagcattttggtccctgctccttgcccatagtaaaacagcttgaaatatcccatgcaagagagtagtttcaagtgggcaactctgctctctatttaaaagcgtgcacaatcaaaagtactatgcaattttaggacaataaagaacatacagtttttttgtgtg

SEQ ID NO: 137647 - DNA, 557 bp, Homo sapiens
  Payload ID: 6954
  Gene Symbol: GFPT2
  Gene Name: glutamine-fructose-6-phosphate transaminase 2
  ENST ID: ENST00000503228
  CDS Start-End: 22-557
taacagaggggtccccaccccatgccgaccgaggtcgctctcctccacgtctcccagtcgcccacaaaggcggccacgcgcaggccggcgcatcccgagtgcggggcgcccatcccgactcagcccgccgcgcccaccgaggagaggagaggcgaccccgccccgccgtccccgcagcccgcccggtcgcccccgctgcgtcagtgcctcaggcagggcctgcgcgtcctcctcgcgaccccaaaggaacgtctggtccctagaagggtcgctgccgcgttaccgcctctttgcgcggggaagaggcagtcactgcccgaacctcggcccgaagccacgagagggagtccggggcggggagcggggccgggcgtccgattcccgcggcgctcccgcgctgtcccgcgtggctgcgggaccgtggggagggcggccgcggcccggagcgcacatctgcaattctttactctcctggctgggccgcctccgctggccgggagagagccgggaacttctgctgggacaaaaggaatctttgcctacatgaactacagagt

SEQ ID NO: 137648 - DNA, 697 bp, Homo sapiens
  Payload ID: 6954
  Gene Symbol: GFPT2
  Gene Name: glutamine-fructose-6-phosphate transaminase 2
  ENST ID: ENST00000518906
  CDS Start-End: 50-697
gtttgcagagagttctcaagccttgaaatcatctctcttcacatctgacatgaacctccttctcaatagcatttctctcttaacttttctttcagaatttgttgtcatccacaatgggatcatcacaaattacaaagatctgaggaaatttctggaaagcaaaggctacgagtttgagtcagaaacagatacagagaccatcgccaagctgattaaatatgtgttcgacaacagagaaactgaggacattacgttttcaacgttggtcgagagagtcattcagcagttggaaggtgcattcgcgctggttttcaagagtgtccactacccaggagaagccgttgccacacggagaggcagccccctgctcatcggagtccggagcaaatacaagctctccacagaacagatccctatcttatacaggacgtgcactctggagaatgtgaagaatatctgtaagacacggatgaagaggctggacagctccgcctgcctgcatgctgtgggcgacaaggccgtggaattcttctttgcttctgatgcaagcgctatcatagagcacaccaaccgggtcatcttcctggaggacgatgacatcgccgcagtggctgatgggaaactctccattcaccgggtcaagcgctcggccagtgatgacccatctcgagccatccagaccttgcagatggaactg

SEQ ID NO: 137649 - DNA, 3083 bp, Homo sapiens
  Payload ID: 6955
  Gene Symbol: QRICH1
  Gene Name: glutamine-rich 1
  Uniprot ID: Q2TAL8
  ENST ID: ENST00000357496
  CDS Start-End: 233-2563
gagggttgaatgtaagatggcgcccagggagctgtgaggagaaaaccctgtcggtcttggagcgacgacggcagaaccagggtccctggcggtgcggcggggccggcgggtgcagcggaggcggcggcggcggcggcagtgacgtcgccggaatattagaagtcttaagaactcaggacaagcagcagaaatacatgcaacatggtgactggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctatta

SEQ ID NO: 137650 - DNA, 3549 bp, Homo sapiens
  Payload ID: 6955
  Gene Symbol: QRICH1
  Gene Name: glutamine-rich 1
  Uniprot ID: Q2TAL8
  ENST ID: ENST00000395443
  CDS Start-End: 474-2804
aaaggaggctctggcgggcgacggaaggtgggtccaaagagctagcttggagccctagccttccgagactccactactaggccaagccacggccctagctccgccccacatggagaggcgtccatgggcggagcgagccgctccataccctaggatccactatccgctctagcggccagaagcgcggccaccttcccctgctgaagcgttcactttaattttggccggtaggcagtcccagatctcgcgggatccgacgccccgattatcgcgagaggagcaatcggctcctattggctgtgagggttgaatgtaagatggcgcccagggagctgtgaggagaaaaccctgtcggtcttggagcgacgacggcagaaccagggtccctggcggtgcggcggggccggcgggtgcagcggaggcggcggcggcggcggcagtgacgtcgccgggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctcttatgtattcttactctagttgtttattaagaatgacaagcacgtcttttcaaca

SEQ ID NO: 137651 - DNA, 583 bp, Homo sapiens
  Payload ID: 6955
  Gene Symbol: QRICH1
  Gene Name: glutamine-rich 1
  ENST ID: ENST00000430979
  CDS Start-End: 439-583
gtaagatggcgcccagggagctgtgaggagaaaaccctgtcggtcttggagcgacgacggcagaaccagggtccctggcggtgcggcggggccggcgggtgcagcggaggcggcggcggcggcggcagtgacgtcgccggaatattagaagtcttaagaactcaggacaagcagcagaaatacatgcaacatggtgactgaaactattagagatgggatttcaccacgttggccagactggtcttgaactcccaacctcaggtgatccgcccacctcagcctcccaaagtgctggggattacaggcgtgagccactgcaccgggccccatatgaatgtattcaaactggactaagctatgaagagccattgttggagtagatgtgaaccttgaggggcctcaaagcccaaggaagaggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacag

SEQ ID NO: 137652 - DNA, 359 bp, Homo sapiens
  Payload ID: 6955
  Gene Symbol: QRICH1
  Gene Name: glutamine-rich 1
  ENST ID: ENST00000411682
  CDS Start-End: 49-359
aaaggaggctctggcgggcgacggaaggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggt

SEQ ID NO: 137653 - DNA, 3009 bp, Homo sapiens
  Payload ID: 6955
  Gene Symbol: QRICH1
  Gene Name: glutamine-rich 1
  Uniprot ID: Q2TAL8
  ENST ID: ENST00000424300
  CDS Start-End: 439-2769
cgcgttcccggcccggatatctctgctctaggagctgtggcccgtgggcaaccgcggctttctggagcgcgcgcccgtgacgacccccagttttggggcgcgcgctctgatatcgggtggcggtgctgcctcgagagcgcgcaggaggcttctgctgagcagagggccggccgcggctcgttgcgctgggaaggttgaggattgggtcctttctggtctggtgacgttcccgggcatccgtggcctcggcctggagagaaaccaaccagctttgctgtctggcttgcggttccgctcctctgtgaggggggcgagattgcccgttctcctcgaagaatgccgttacttgaggcccaaaatattagaagtcttaagaactcaggacaagcagcagaaatacatgcaacatggtgactggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtccta

SEQ ID NO: 137654 - DNA, 426 bp, Homo sapiens
  Payload ID: 6955
  Gene Symbol: QRICH1
  Gene Name: glutamine-rich 1
  ENST ID: ENST00000450685
  CDS Start-End: 116-426
cgagccgctccataccctaggatccactatccgctctagcggccagaagcgcggccaccttcccctgctgaagcgttcactttaattttggccggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggt

SEQ ID NO: 137655 - DNA, 510 bp, Homo sapiens
  Payload ID: 6955
  Gene Symbol: QRICH1
  Gene Name: glutamine-rich 1
  ENST ID: ENST00000437939
  CDS Start-End: 200-510
attggctgtgagggttgaatgtaagatggcgcccagggagctgtgaggagaaaaccctgtcggtcttggagcgacgacggcagaaccagggtccctggcggtgcggcggggccggcgggtgcagcggaggcggcggcggcggcggcagtgacgtcgccgggtgagggctccagtgcgggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggt

SEQ ID NO: 137656 - DNA, 1739 bp, Homo sapiens
  Payload ID: 6956
  Gene Symbol: QPCT
  Gene Name: glutaminyl-peptide cyclotransferase
  Uniprot ID: Q16769
  ENST ID: ENST00000338415
  CDS Start-End: 159-1244
ctgcagcctgcgcgacgcggcgggaggctacccgggggcgatgggaaggcgggcgcagtcgacccaagggtggagaagagggaaggcgaaggacgcgcgttcccgggctcgtgaccgccagcggcccggggaacccgctcccagacagactcggagagatggcaggcggaagacaccggcgcgtcgtgggcaccctccacctgctgctgctggtggccgccctgccctgggcatccaggggggtcagtccgagtgcctcagcctggccagaggagaagaattaccaccagccagccattttgaattcatcggctcttcggcaaattgcagaaggcaccagtatctctgaaatgtggcaaaatgacttacagccattgctgatagagcgatacccgggatcccctggaagctatgctgctcgtcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagagggaccgtgtaaagaaaatggaaaataaatatctttcaaagactcttttagataaacacgatgaggcaaaatcaggttcattcattcaacgatagtttctcaacagtacttaaatagcggttggaaaacgtagccttcattttatgattttttcatatgtggaaatctattacatgtaatacaaaacaaacatgtagtttgaaggcggtcagatttctttgagaaatctttgtagagttaattttatggaaattaaaatcagaattaaatgcta

SEQ ID NO: 137657 - DNA, 992 bp, Homo sapiens
  Payload ID: 6956
  Gene Symbol: QPCT
  Gene Name: glutaminyl-peptide cyclotransferase
  ENST ID: ENST00000404976
  CDS Start-End: 139-992
cgggaggctacccgggggcgatgggaaggcgggcgcagtcgacccaagggtggagaagagggaaggcgaaggacgcgcgttcccgggctcgtgaccgccagcggcccggggaacccgctcccagacagactcggagagatggcaggcggaagacaccggcgcgtcgtgggcaccctccacctgctgctgctggtggccgccctgccctgggcatccaggggggtcagtccgagtgcctcagcctggccagaggagaagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatga

SEQ ID NO: 137658 - DNA, 714 bp, Homo sapiens
  Payload ID: 6956
  Gene Symbol: QPCT
  Gene Name: glutaminyl-peptide cyclotransferase
  ENST ID: ENST00000444022
  CDS Start-End: 362-714
cccattcctgggcccacactccatccctaatccctcccccgacccctgcatcttctcctgactctgactctcttcccatatttgatcttctttctgtccccacgtcttcactaaccccagcttggaacctcatgctacccttgagacttcactagccccggtgccttcatccctccctgacgctcaccccatctgtgaactgatagcttattcccagcacccccgcttattcctatccattgccctatcactgaccttcgccctataaaagtacaaatggtcacattctgtgtcctctgtgaccctaacacacctcctgttggcatttgctctccctcctgttatccattggcagctcctaatgggccaggggaatgtggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagt

SEQ ID NO: 137659 - DNA, 2310 bp, Homo sapiens
  Payload ID: 6957
  Gene Symbol: QPCTL
  Gene Name: glutaminyl-peptide cyclotransferase-like
  Uniprot ID: Q9NXS2
  ENST ID: ENST00000012049
  CDS Start-End: 222-1370
catttgggtcgtgccattctcaggggaaccaaccccaatacctaagggaggctgggaggcgtgtcctcaggaccgtagttcttattggtttcgctgctcgctgtggggtgggctggtgcagccgcagctgttgcttattggcccaccgattccatggggaggaacttggctgggcctaaactcaatccgtggtctggtacaggtttcagggcaaagcggccatgcgttccgggggccgcgggcgaccccgcctgcggctgggggaacgtggcctcatggagccactcttgccgccgaagcgccgcctgctaccgcgggttcggctcttgcctctgttgctggcgctggccgtgggctcggcgttctacaccatttggagcggctggcaccgcaggactgaggagctgccgctgggccgggagctgcgggtcccattgatcggaagcctccccgaagcccggctgcggagggtggtgggacaactggatccacagcgtctctggagcacttatctgcgccccctgctggttgtgcgaaccccgggcagcccgggaaatctccaagtcagaaagttcctggaggccacgctgcggtccctgacagcaggttggcacgtggagctggatcccttcacagcctcaacacccctggggccagtggactttggcaatgtggtggccacactggacccaagggctgcccgtcacctcacccttgcctgccattatgactcgaagctcttcccacccggatcgaccccctttgtaggggccacggattcggctgtgccctgtgccctgctgctggagctggcccaagcacttgacctggagctgagcagggccaaaaaacaggcagccccggtgaccctgcaactgctcttcttggatggtgaagaggcgctgaaggagtggggacccaaggactccctttacggttcccggcacctggcccagctcatggagtctatacctcacagccccggccccaccaggatccaggctattgagctctttatgcttcttgatctcctgggagcccccaatcccaccttctacagccacttccctcgcacggtccgctggttccatcggctgaggagcattgagaagcgtctgcaccgtttgaacctgctgcagtctcatccccaggaagtgatgtacttccaacccggggagccctttggctctgtggaagacgaccacatccccttcctccgcagaggggtacccgtgctccatctcatctccacgcccttccctgctgtctggcacacccctgcggacaccgaggtcaatctccacccacccacggtacacaacttgtgccgcattctcgctgtgttcctggctgaatacctggggctctagcgtgcttggccaatgactgtggagaggactgtgagagagaaggtcccagcgggggccagtgaagctcaggcaggatctgcctagggtgtgctggtttgtccttttcatacctttgtctcctaattgtgctacaattggaagaccttctttcttttgattgtctcaagctgccacccttcaaggacagggaagagaccactgtgggatgacagccagaggaataagaacttgctccctccccagaggtaaacacttggtccaaaggtttgcagggaccaaatactgttctttttttttttgagacggagtctcactgtgttgcccaggctggagtgcagtggtgcgatctcggctcactgcaaactccgcctcctgggttcacgccattctcctgcctcagcctcccaagtagctgggactacaggtgcccgccaccacgctggctaattttttgtatttttagtagagacggggtttcaccgtgttagccaggatggtctcgatctcctgaccttgtaatccgccagcctcggcctcccaaagtgctgggattacaggtgtgagccaccgcacctggcaaaatgctgttctttaagtcagcgaactgaaaaagtaaaagactgctgggtgtggtggctcacacctgtaatcccaacactttgagaggctgagggggaaggatcacccgaggtcaggagtttgagaccagcctggtcaacatggcgaaaccctgtctctactaaaaatacaataattagctgggcatggtggtgggcgcctgtaatctcagctgcttgggaggctgaggcaggagaatcacttgtacgcaggaggcggaggttgcagtgagccaagatcacaccactgcactccagcctgggcaacagagcgagactccatctcaataaataaataaataaataaatattttttaaaaaga

SEQ ID NO: 137660 - DNA, 1814 bp, Homo sapiens
  Payload ID: 6957
  Gene Symbol: QPCTL
  Gene Name: glutaminyl-peptide cyclotransferase-like
  Uniprot ID: Q9NXS2
  ENST ID: ENST00000366382
  CDS Start-End: 8-874
agcggccatgcgttccgggggccgcgggcgaccccgcctgcggctgggggaacgtggcctcatggagccactcttgccgccgaagcgccgcctgctaccgcgggttcggctcttgcctctgttgctggcgctggccgtgggctcggcgttctacaccatttggagcggctggcaccgcaggactgaggagctgccgctgggccgggagctgcgggtcccattgatcggaagcctccccgaagcccggctgcggagggtggtgggacaactggatccacagcgtctctggagcacttatctgcgccccctgctggttgtgcgaaccccgggcagcccgggaaatctccaagtcagaaaggcagccccggtgaccctgcaactgctcttcttggatggtgaagaggcgctgaaggagtggggacccaaggactccctttacggttcccggcacctggcccagctcatggagtctatacctcacagccccggccccaccaggatccaggctattgagctctttatgcttcttgatctcctgggagcccccaatcccaccttctacagccacttccctcgcacggtccgctggttccatcggctgaggagcattgagaagcgtctgcaccgtttgaacctgctgcagtctcatccccaggaagtgatgtacttccaacccggggagccctttggctctgtggaagacgaccacatccccttcctccgcagaggggtacccgtgctccatctcatctccacgcccttccctgctgtctggcacacccctgcggacaccgaggtcaatctccacccacccacggtacacaacttgtgccgcattctcgctgtgttcctggctgaatacctggggctctagcgtgcttggccaatgactgtggagaggactgtgagagagaaggtcccagcgggggccagtgaagctcaggcaggatctgcctagggtgtgctggtttgtccttttcatacctttgtctcctaattgtgctacaattggaagaccttctttcttttgattgtctcaagctgccacccttcaaggacagggaagagaccactgtgggatgacagccagaggaataagaacttgctccctccccagaggtaaacacttggtccaaaggtttgcagggaccaaatactgttctttttttttttgagacggagtctcactgtgttgcccaggctggagtgcagtggtgcgatctcggctcactgcaaactccgcctcctgggttcacgccattctcctgcctcagcctcccaagtagctgggactacaggtgcccgccaccacgctggctaattttttgtatttttagtagagacggggtttcaccgtgttagccaggatggtctcgatctcctgaccttgtaatccgccagcctcggcctcccaaagtgctgggattacaggtgtgagccaccgcacctggcaaaatgctgttctttaagtcagcgaactgaaaaagtaaaagactgctgggtgtggtggctcacacctgtaatcccaacactttgagaggctgagggggaaggatcacccgaggtcaggagtttgagaccagcctggtcaacatggcgaaaccctgtctctactaaaaatacaataattagctgggcatggtggtgggcgcctgtaatctcagctgcttgggaggctgaggcaggagaatcacttgtacgcaggaggcggaggttgcagtgagccaagatcacaccactgcactccagcctgggcaacagagcgagactccatctcaataaataaataaataaataaatattttttaaaaaga

SEQ ID NO: 137661 - DNA, 561 bp, Homo sapiens
  Payload ID: 6957
  Gene Symbol: QPCTL
  Gene Name: glutaminyl-peptide cyclotransferase-like
  ENST ID: ENST00000591606
  CDS Start-End: 1-366
atggagccactcttgccgccgaagcgccgcctgctaccgcgggttcggctcttgcctctgttgctggcgctggccgtgggctcggcgttctacaccatttggagcggctggcaccgcaggactgaggagctgccgctgggccgggagctgcgggtcccattgatcggaagcctccccgaagcccggctgcggagggtggtgggacaactggatccacagcgtctctggagcacttatctgcgccccctgctggttgtgcgaaccccgggcagcccgggaaatctccaagtcagaaaggggccacggattcggctgtgccctgtgccctgctgctggagctggcccaagcacttgacctggagctgagcagggccaaaaaacaggcagccccggtgaccctgcaactgctcttcttggatggtgaagaggcgctgaaggagtggggacccaaggactccctttacggttcccggcacctggcccagctcatggagtctatacctcacagccccggccccaccaggatccaggctattgagctctttatgcttcttgatctcc

SEQ ID NO: 137662 - DNA, 2158 bp, Homo sapiens
  Payload ID: 6958
  Gene Symbol: QRSL1
  Gene Name: glutaminyl-tRNA synthase (glutamine-hydrolyzing)-like 1
  ENST ID: ENST00000369044
  CDS Start-End: 69-1028
actagcgaccggtgacctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggtaactttttcctttcattactttacagaaatactgtcaagtccaatagagagcacagacttgggaggcggattgggtgggtttgaatctctgctctgccacttttattaatcatgtgagttgagtatgtgacttaatctcttttagctcaatttccccatctgtaaaataggaataataaaaatactgacttcagagaggtttgtgaggatcaattagacagtcatgttaagtctgtaaattgtttctgtaatgggcaagatagcaaatattttagattttgtggaccatgcagtctttatcataactgcttaactgccattatagtgagaaagcagccacagacaatatgtaaatgaaaaagtgtgtctctgttccaataaaactttattttcaaaaaccagctggcttgtcacatctggcctatgggccatagtttgcccatccctaatgtaaagaaaggactttagcccaaagccacaacttgcatagtaatgcctcaaaaaatgttaacatctttactgttattattattactactgcatctattacagtagcaattgagtaatgaatacatgaatgttataatgttaaattactaaccttttaaaaatattaagcattgcaatatattaatactttaaatcttttaggaagataagttaccctgcagaataatgaagtttcacaacctcagcactgttggtgtttggggctggtaattgtttgttgtgggagactgtcctgtgcattgtaagatgtttagtagcatccctggcctctacccctacatgcaagtagtaccccaccaccaaaaccacaatcccacaaccaaaaatgtctgcagacattgtcaagtgtctcctggttagggaaaaggagacaaaagtaacccccaggtaagaccactgctatagagaaatactaccttatttaaaatcttccattaaggtaatatatgtaaggccaggtgcgtacacctgtaatcccagcaccttgggaagccaaggcaggaggatcgcttgagatcaggagtttgagaccagcctgggcaacatacagagccctatgtctacaaaaagttttaaaaaaattgtggggtgtggtggtgtgcacctgtggtcctagctgtttgggaggctgaggggggaggattgcttgagtccaggaggttgagactgccgtgagccatgattgcaccactgcactccaccctaggtgacagagcaagaccctatctc

SEQ ID NO: 137663 - DNA, 4106 bp, Homo sapiens
  Payload ID: 6958
  Gene Symbol: QRSL1
  Gene Name: glutaminyl-tRNA synthase (glutamine-hydrolyzing)-like 1
  Uniprot ID: Q9H0R6
  ENST ID: ENST00000369046
  CDS Start-End: 105-1691
agtgacaattaaagatggctgcgcccatgtaacatcactagcgaccggtgacctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaaagagagagagagagagatgggctctccctgtgttgcccaggctagtctcaaactcctgggctcaagtgatctgcctccctcagcctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacagaa

SEQ ID NO: 137664 - DNA, 2827 bp, Homo sapiens
  Payload ID: 6959
  Gene Symbol: QARS
  Gene Name: glutaminyl-tRNA synthetase
  Uniprot ID: P47897
  ENST ID: ENST00000306125
  CDS Start-End: 403-2730
cagggactcgcatttgcccccgaggacaattactatattgagatggagttaccagggctgaagtagaaaagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctaga

SEQ ID NO: 137665 - DNA, 2399 bp, Homo sapiens
  Payload ID: 6959
  Gene Symbol: QARS
  Gene Name: glutaminyl-tRNA synthetase
  ENST ID: ENST00000430182
  CDS Start-End: 25-327
cttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctag

SEQ ID NO: 137666 - DNA, 2412 bp, Homo sapiens
  Payload ID: 6959
  Gene Symbol: QARS
  Gene Name: glutaminyl-tRNA synthetase
  Uniprot ID: P47897
  ENST ID: ENST00000414533
  CDS Start-End: 26-2320
tcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccactgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctc

SEQ ID NO: 137667 - DNA, 1044 bp, Homo sapiens
  Payload ID: 6959
  Gene Symbol: QARS
  Gene Name: glutaminyl-tRNA synthetase
  ENST ID: ENST00000452739
  CDS Start-End: 28-1044
tttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgggtggtggtgccagggcttaacttttcaggaggccagactatccttggagtttcatgagattaggaccctgtctgtccacttcttggagcagagatgccacaaactcacgggctctttcttctcagctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatc

SEQ ID NO: 137668 - DNA, 859 bp, Homo sapiens
  Payload ID: 6959
  Gene Symbol: QARS
  Gene Name: glutaminyl-tRNA synthetase
  ENST ID: ENST00000453392
  CDS Start-End: 1-762
cagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctgcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctaga

SEQ ID NO: 137669 - DNA, 558 bp, Homo sapiens
  Payload ID: 6959
  Gene Symbol: QARS
  Gene Name: glutaminyl-tRNA synthetase
  ENST ID: ENST00000418549
  CDS Start-End: 25-327
cttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggaggcggaggttgcagtgagcggagactgtgccattgcattccagcctgggcaacatgagcaagact

SEQ ID NO: 137670 - DNA, 599 bp, Homo sapiens
  Payload ID: 6959
  Gene Symbol: QARS
  Gene Name: glutaminyl-tRNA synthetase
  ENST ID: ENST00000634802
  CDS Start-End: 25-228
cttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcagctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagacccca

SEQ ID NO: 137671 - DNA, 582 bp, Homo sapiens
  Payload ID: 6959
  Gene Symbol: QARS
  Gene Name: glutaminyl-tRNA synthetase
  ENST ID: ENST00000635194
  CDS Start-End: 20-582
agtttccggtgtctctgcaatggcggctctagactccctgtcgctcttcactagcctcggcctgagcgagcagaaggcccgcgagacgctcaagaactcggctctgagcgcgcagctgcgcgaggccgctactcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaa

SEQ ID NO: 137672 - DNA, 280 bp, Homo sapiens
  Payload ID: 6959
  Gene Symbol: QARS
  Gene Name: glutaminyl-tRNA synthetase
  ENST ID: ENST00000475599
  CDS Start-End: 1-81
cagggtggtgtgaagtggtgcaatcatagctcactgtggcctcaaactactgggctcaagctattctcctgccttagctgagactacatgtgcacactaccatgcctggctaattttaaaactttttgtagagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctag

SEQ ID NO: 137673 - DNA, 2362 bp, Homo sapiens
  Payload ID: 6959
  Gene Symbol: QARS
  Gene Name: glutaminyl-tRNA synthetase
  ENST ID: ENST00000464962
  CDS Start-End: 380-2272
tttgtcccgccctttcctctcactgagcgcggggcttctctcttgacccctctgacctcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattc

SEQ ID NO: 137674 - DNA, 732 bp, Homo sapiens
  Payload ID: 6959
  Gene Symbol: QARS
  Gene Name: glutaminyl-tRNA synthetase
  ENST ID: ENST00000634527
  CDS Start-End: 445-732
actcgcatttgcccccgaggacaattactatattgagatggagttaccagggctgaagtagaaaagtcagagcaaaaccacgcctgtgtcttcctcctgcctcagggacgaacaccttccttccaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagacccca

SEQ ID NO: 137675 - DNA, 574 bp, Homo sapiens
  Payload ID: 6959
  Gene Symbol: QARS
  Gene Name: glutaminyl-tRNA synthetase
  ENST ID: ENST00000635292
  CDS Start-End: 1-574
accctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatggaggtggggggagtactcttttttgcctttctgcagctccttgtgcctatgcttctaggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctg

SEQ ID NO: 137676 - DNA, 544 bp, Homo sapiens
  Payload ID: 6959
  Gene Symbol: QARS
  Gene Name: glutaminyl-tRNA synthetase
  ENST ID: ENST00000634602
  CDS Start-End: 25-544
cttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcgagactgctgaccagaccctgtctctgatggagc

SEQ ID NO: 137677 - DNA, 582 bp, Homo sapiens
  Payload ID: 6959
  Gene Symbol: QARS
  Gene Name: glutaminyl-tRNA synthetase
  ENST ID: ENST00000634432
  CDS Start-End: 1-582
ttttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgt

SEQ ID NO: 137678 - DNA, 1053 bp, Homo sapiens
  Payload ID: 6959
  Gene Symbol: QARS
  Gene Name: glutaminyl-tRNA synthetase
  ENST ID: ENST00000635443
  CDS Start-End: 28-1053
tttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactccacacaccatgaatctactaaagcagcacctggagattactggtgggcaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctg

SEQ ID NO: 137679 - DNA, 1023 bp, Homo sapiens
  Payload ID: 6959
  Gene Symbol: QARS
  Gene Name: glutaminyl-tRNA synthetase
  ENST ID: ENST00000494767
  CDS Start-End: 26-550
tcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatggctccttgtgcctatgcttctaggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctag

SEQ ID NO: 137680 - DNA, 643 bp, Homo sapiens
  Payload ID: 6959
  Gene Symbol: QARS
  Gene Name: glutaminyl-tRNA synthetase
  ENST ID: ENST00000634473
  CDS Start-End: 1-405
gccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctgcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctc

SEQ ID NO: 137681 - DNA, 486 bp, Homo sapiens
  Payload ID: 6959
  Gene Symbol: QARS
  Gene Name: glutaminyl-tRNA synthetase
  ENST ID: ENST00000634336
  CDS Start-End: 1-250
gccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactgcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattc

SEQ ID NO: 137682 - DNA, 568 bp, Homo sapiens
  Payload ID: 6959
  Gene Symbol: QARS
  Gene Name: glutaminyl-tRNA synthetase
  ENST ID: ENST00000635494
  CDS Start-End: 27-329
ttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggtgagcagggcctggaacggggctatattgttctctctggtcatgccttttcttctgggcacgagtgagaaggaggagaggctcgggctgtgctgaagtgggcagatggcaaaatgatcaagaatgaagtggacatgcag

SEQ ID NO: 137683 - DNA, 907 bp, Homo sapiens
  Payload ID: 6959
  Gene Symbol: QARS
  Gene Name: glutaminyl-tRNA synthetase
  ENST ID: ENST00000635541
  CDS Start-End: 387-907
actgagcgcggggcttctctcttgacccctctgacctcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatggctccttgtgcctatgcttctaggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacat

SEQ ID NO: 137684 - DNA, 451 bp, Homo sapiens
  Payload ID: 6959
  Gene Symbol: QARS
  Gene Name: glutaminyl-tRNA synthetase
  ENST ID: ENST00000487495
  CDS Start-End: 1-228
gcatcactacacgtggtggatgcagcattagtggactgctctgtggccctggcaaaacccttcgacaagttccagtttgagcgtcttggatatttctccgtggatccagacagccatcagggaaagagacggggtcttactcttgcccagggtggtgtgaagtggtgcaatcatagctcactgtggcctcaaactactgggctcaagctattctcctgccttagctgagactacatgtgcacactaccatgcctggctaattttaaaactttttgtagaggcaagttctcactatgttgcccagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctag

SEQ ID NO: 137685 - DNA, 570 bp, Homo sapiens
  Payload ID: 6959
  Gene Symbol: QARS
  Gene Name: glutaminyl-tRNA synthetase
  ENST ID: ENST00000635052
  CDS Start-End: 25-327
cttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatggctccttgtgcctatgcttctaggagaggctcgggctgtgctgaagtgggcagatggcaaaatgatcaagaatgaagtggacatgcaggtcctccaccttctgggccccaagttggaggctgatctggagaagaagttcaaggtg

SEQ ID NO: 137686 - DNA, 334 bp, Homo sapiens
  Payload ID: 6959
  Gene Symbol: QARS
  Gene Name: glutaminyl-tRNA synthetase
  ENST ID: ENST00000466179
  CDS Start-End: 1-276
tccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaaggtgagagccagctgcagccttcctactgcagtgcctgctggggccaagatcttgtctttaaccgaactgtcacactgaaggaagacccaggaaaggtgtgagctggaagcactgaacctacctcatcctcctggag

SEQ ID NO: 137687 - DNA, 578 bp, Homo sapiens
  Payload ID: 6959
  Gene Symbol: QARS
  Gene Name: glutaminyl-tRNA synthetase
  ENST ID: ENST00000635231
  CDS Start-End: 31-578
aagtttcttttagtttccggtgtctctgcaatggcggctctagactccctgtcgctcttcactagcctcggcctgagcgagcagaaggcccgcgagacgctcaagaactcggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcg

SEQ ID NO: 137688 - DNA, 701 bp, Homo sapiens
  Payload ID: 6959
  Gene Symbol: QARS
  Gene Name: glutaminyl-tRNA synthetase
  ENST ID: ENST00000635622
  CDS Start-End: 496-701
agaaaagtcagagcaaaaccacgcctgtgtcttcctcctgcctcagggacgaacaccttccttccagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatggctccttgtgcctatgcttctaggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgacca

SEQ ID NO: 137689 - DNA, 6943 bp, Homo sapiens
  Payload ID: 6960
  Gene Symbol: ENPEP
  Gene Name: glutamyl aminopeptidase (aminopeptidase A)
  Uniprot ID: Q07075
  ENST ID: ENST00000265162
  CDS Start-End: 343-3216
gttttatatttaactcgctgcagtgcaggaggggtaggggtggagatgcgtcgtttataaggggagctgtgacaatcttcttgccagccctcttcctcccactcggctcctcttacggagtcctcattccaccccccttgtttccgcattcatcctgagtggctggtgggaacgtgaaaagggagaggaaaaggcgcaagaagccagagagaggggtgtgggaaaagcgaaaacaggctgccaaatcaggggattccttccaatttaaaaaggaagtctgctgacgttagttagttaaatttaacatctttttatgtgtaacacttgactttggaagcaaaaatgaactttgcggagagagagggctctaagagatactgcattcaaacgaaacatgtggccattctctgtgcggtggtggtgggtgtaggattaatagtgggacttgccgtgggcttgaccagatcgtgtgactccagcggggacggcgggccgggcactgcgccagctccttcccacctgccttcttccacggccagcccctcaggtcctcctgcccaggaccaggacatctgcccggccagtgaggatgagagcggacagtggaaaaactttcgactgccggacttcgtcaacccagtccactacgacctgcacgtgaagcccctgttggaggaggacacctacacgggcaccgtgagcatctccatcaacctgagcgctcccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacggacaagtcaagagcatagtggccaccgatcatgaaccaacagatgccaggaaatcttttccttgttttgatgagcccaacaaaaaggcaacttatacaatatctatcacccatcccaaagaatacggagcactttcaaatatgccagtggcgaaagaagagtcagtggatgataaatggactcgaacaacttttgagaagtctgtccccatgagcacgtacctggtgtgctttgctgtacatcaatttgactctgtaaagagaatatcaaatagtggaaaacctcttacaatttatgtccagccagagcaaaagcacacagccgaatatgctgcaaacataactaaaagtgtgtttgattattttgaagaatactttgctatgaattattctcttcctaaattagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcagtggtttggaaatattgtgaccatggactggtgggaagacttgtggctaaatgaaggatttgcttctttctttgagtttctgggagtaaaccatgcagaaacagactggcaaatgcgtgaccaaatgttacttgaagatgtattacctgttcaagaggatgattctttgatgtcttcgcatccaattattgtgactgtgacaacccctgatgaaataacatctgtttttgatggaatatcctatagcaagggatcttctattttgagaatgcttgaagactggataaaaccagagaattttcaaaaaggatgtcagatgtacttggaaaaataccaattcaagaatgcaaaaacttctgatttttgggcagcactggaagaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaaggaatcactttgaactcctctaatcctagtggaaatgcttttctcaaaataaacccagatcatattgggttttatcgtgtaaattatgaagtagcaacttgggactcgatagctacagcgctctccttgaaccacaagacattttcttcagcagatcgtgcaagtcttattgatgatgcttttgccttggcaagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggaatacttccaaggtcaagtgaagcctattgcagattctctgggatggaatgatgctggagaccatgtcacaaagttactccgttcctccgtgttagggtttgcgtgcaagatgggagacagagaagccttgaacaatgcttcctcgttatttgagcagtggctaaatgggactgtaagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtatttggatttgctcaaggacacgaaccttattaaaactcaggatgtgtttacagtcattcgatatatctcatataacagctatgggaagaacatggcctggaattggatacaactcaactgggactatctagtcaacagatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaatgtattcaaatgttagagtttaattttgtgaatctattgtttctcctctgaagcatttggtggcctaatttacaagcacgatggagagagccttataaacagataatgcttttactaagcactgtgtttatatgtcttgcaaagcctttaaattgttcctctttgtttatgaagaaagatactaatagagtacttaatatactcagggattccttctaagtgtacttcataagatattctttacaaactgaagataatgaaatagttattttaatacctttaaatatcattctttgtatcttaaatctgtgaagtagaacaatttggtcttagctttacattttcagtaccaaagaaacaccacttaatcttctctcttgattgatttttaaagtttaaataccagtacttgagggaccaatattaccatcttaatctttattttattattcagaattatacagacctaatatcattttattcacatatgtcttactactttaaatcctaccaaagtaacctgggcttaagttttacttgaggatcatatgaattagccaaaagaatggctgactgttgcctttgctcttataaaatcaataagagaactctcctctttttttaaaaataaatctaaatgattatcttgaaaaagtattgttttccagtgtcacttgactcttgaataaaaataactgcagtgttccccaaataatttaacacattgcaaatatgattcaagaatctggcctttttcatgcttggtactctcttctcttgctccattccttacaaagctccttcaaatatgctatgaaattagagggaacatagtgcttaactctgctccatggattttagaggaaaaaagctaaataattggaaactgttcaggaaagagagaaggcagattatttcttaaaactaaatggaattagaatttagctttgacctcacctagcaatctaagtgtgaaaatggggagacctgtgggcatccccagcatgactctgcatatctgagcatatatctccttatagatcaattttatgtataaacccttagatcctaatccatacagaatagcactgatcaaatttaaatgcatgacttgattaaagacatcaatttcatagaagctggtggcaagaatatgtttaatatggcacttgatacctcctagatccataatgtaagtccaataggcagaaaagatggtaagttactatgtttcaatctgctatatctagaaaatctaaatttatttggaactttcaaaaatgtaaggtaatttagaatcggcttgatgagaattgaagcatatggaaacaaaaccttagctttaactttatttatacaataatgtgccctaatcatgtactctgaaactttataaactttcctgttgctgtttcttaattatcacttctcaatccgtacagccaaactagtaaattcaaatgtagactgggttgtgggtggcagatatagaagaagaaatttccagaccaaaaaatattaaatattattttaaattatttcagaagcaaaaacatattaacatcataacttaccagaaaaaccccactatcctcataagattaacttaaaattctgaccacaatcagaaccagcacttgaagtctatgtattgtttcaagtaggacatattatgaggtgagatggtttatccttctgttttatgaaattaatacattttaaaagaaaaatgttagtttaagggggtggtaaataaaacagatttcaacttgcctacaagacattctatttcatgccttttccttttgttgttctatttcattctattttaagcattaaaactgagaacaaattgtttacttcttttcactccacacgcgaaagagttgtatgtactttgtcagaataagtcttctagaccatcaggtccttctcaaacaacacctgttttttaaaaggctgatgcctaatagatagatctatgccaagcacagtttattactttgcttgcttggttttgcacagtattcacaggggacaaaaaatttaatatgatgtttccaaaattaagccacagtaaatttaaataattaattttaattgaaaaaaagtaaccatttaatttcaagaattaactggaaaatatgggaagcaaggtcatgtagcaaaaagcaaggccagtattactgcctcccctctaggcagcccactcctgtattccagatcattgctatgtacccacataattataaattaggagtttaaataataaaacatagacgtaaaactgacaggcaagggaggtttgggaaacaggggtgagatgtatacctgggttgaaggtaatgatactcctacagcttaccctccaagttggtgaagtgttagtccaaaagtagaaacaacagagtaggggcaaaaatctagaacaataattctcaaagggaattgggggatgagaaggaagtagaaaagaggggattcaaattaccagtggtgctttctaaaacacggttaggtaatcatcatcatcagactttcctttttttttcaagcatttttataaacactagcactccacataacattaatttttacaaaacccccttaaagtagatactgttattgttcttattttagagtggataaattgagatggagaagttatagaacttgcacaaggctacaaaagttgtatttggcaccagccagtatttgaacccaggcagtttatcactctaatctacattttaatctgtattagagtaaaaatatgcttttgaaatcagagtgacctgggttggaatatcaactacttggtagttgagtgcttttaacctctccattgttgtttcatctataaagtaaggatcaaaatagtagctacctcaatggtagttgtgaggattaaatacaaaaatgcatgtaaaggacatacgtataggaaataacaatcactcaataagtgttagctcttattattgttactattatatctccccatccctacttaagacactagtttgaagaataaaataaactttggttcaggaataaccaaacctaagcaactgaaggcactaagggtaggctatgtgttagcctgtgttattgttcataaatagtaattgccctggtctggaagaggattctatatcctaccccattgtagtctagcatggtatgtgacttgctttggccagtgaaacagagtgaaaatgatgtatgtcaattttaggcagaaacgtccagagccagcacttggtttgccatgttctccgtgtttcttctgctcctagatgcagcagtattccagatagaggccgcactatgagcctgaattccaggataaaaacaacatggaatagaacttagccagcacagagtacacatgtgctgtaaatgagaaatacccctttgttattgtaaatcactgagattttgaggttgtctgttactgcagcataatctagcctaatataaacaccaaactaatatactcctctaccatagtaatttatttcttgttctttctcctcctccttcctctacttcagggtttagcgaccttttgcctgcctgtttttgtaaggcctgaaagctaaacatagttttacatttttagatggttgaaaaaatcaaaaggagaataatagttcatgatgtaaaaattatataaaatttaaataaatgtcggcatccttaaataaagttttattggaacaca

SEQ ID NO: 137690 - DNA, 767 bp, Homo sapiens
  Payload ID: 6960
  Gene Symbol: ENPEP
  Gene Name: glutamyl aminopeptidase (aminopeptidase A)
  ENST ID: ENST00000509344
  CDS Start-End: 1-433
tgtgactgtgacaacccctgatgaaataacatctgtttttgatggaatatcctatagcaagggatcttctattttgagaatgcttgaagactggataaaaccagagaattttcaaaaaggatgtcagatgtacttggaaaaataccaattcaagaatgcaaaaacttctgatttttgggcagcactggaagaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaagttaattgaggattggaagaatatctcggcagctgtttgatttactgtttacaagtttgaaagcgtgaataattcatctaccctagtacaattcacccagcactttcatggaatgaagtttccatacaagtgaattttccagataactaaagcttactcaagtgctttgtaaaatgcatttcaagagttcacaatagacattgttctaatatgtgttatgtactccttagaatatttggaataataaatttaatccttaattactagattaattctttcaagcacgtattgcttatgtgcaaaacacagagataagaatgggggcagtgctggagcaaaaaaa

SEQ ID NO: 137691 - DNA, 5014 bp, Homo sapiens
  Payload ID: 6961
  Gene Symbol: EPRS
  Gene Name: glutamyl-prolyl-tRNA synthetase
  Uniprot ID: P07814
  ENST ID: ENST00000366923
  CDS Start-End: 271-4809
agcacgaaaggccacgcaggccgttctaaccctggcggccaagaggaggggtagcaggctctggaacctgcgggcggggacgaagacggcgcgcgacgatgtcgcaccgcggcgtgcgcggtgtcggcagtagctgcggcgcaggggcggagcgaaggctgcggcggcgtcgggtacgcgcacacgttgcatcttcttcctttcgcggggtcctccgtagttctggcacgagccaggcgtactgacaggtggaccagcggactggtggagatggcgacgctctctctgaccgtgaattcaggagaccctccgctaggagctttgctggcagtagaacacgtgaaagacgatgtcagcatttccgttgaagaagggaaagagaatattcttcatgtttctgaaaatgtgatattcacagatgtgaattctatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagactctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacagtcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaacta

SEQ ID NO: 137692 - DNA, 2968 bp, Homo sapiens
  Payload ID: 6961
  Gene Symbol: EPRS
  Gene Name: glutamyl-prolyl-tRNA synthetase
  ENST ID: ENST00000609181
  CDS Start-End: 64-2968
gggtcctccgtagttctggcacgagccaggcgtactgacaggtggaccagcggactggtggagatggcgacgctctctctgaccgtgaattcaggagaccctccgctaggagctttgctggcagtagaacacgtgaaagacgatgtcagcatttccgttgaagaagggaaagagaatattcttcatgtttctgaaaatgtgatattcacagatgtgaattctatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagactctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaagctgcgagctctctgtaagaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaag

SEQ ID NO: 137693 - DNA, 1526 bp, Homo sapiens
  Payload ID: 6961
  Gene Symbol: EPRS
  Gene Name: glutamyl-prolyl-tRNA synthetase
  ENST ID: ENST00000477030
  CDS Start-End: 143-727
agtagctgcggcgcaggggcggagcgaaggctgcggcggcgtcgggtacgcgcacacgttgcatcttcttcctttcgcggggtcctccgtagttctggcacgagccaggcgtactgacaggtggaccagcggactggtggagatggcgacgctctctctgaccgtgaattcaggagaccctccgctaggagctttgctggcagtagaacacgtgaaagacgatgtcagcatttccgttgaagaagggaaagagaatattcttcatgtttctgaaaatgtgatattcacagatgtgaattctatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtgttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagactctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaaggatgacccaagatttcctacggttcgtggtgtactgagaagagggatgacagttgaaggactgaaacagtttattgctgctcaggttattgacccagtggctccacgatatgttgcattactgaagaaagaagtgatcccagtgaatgtacctgaagctcaggaggagatgaaagaagtagccaaacacccaaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcac

SEQ ID NO: 137694 - DNA, 3961 bp, Homo sapiens
  Payload ID: 6962
  Gene Symbol: EARS2
  Gene Name: glutamyl-tRNA synthetase 2, mitochondrial
  Uniprot ID: Q5JPH6
  ENST ID: ENST00000449606
  CDS Start-End: 33-1604
gggagaagcccacgtgtgctattccatcccacatggcggcgctcctgaggagactgctgcagcgcgagaggccttcggcggcctctggccgccccgtaggacggcgcgaggccaacctgggcactgatgccggggttgcggtgcgagtgcggttcgctcccagccccacaggcttcttgcacctgggtggcctccgcactgccttgtacaactacatctttgctaagaagtaccaggggagcttcatcctgaggctagaggacacagatcagactcgcgttgtgcctggggcagcggagaatattgaggacatgctggagtgggcaggcatcccgcctgatgagagcccccgccggggcggtcctgctgggccctaccagcaatctcagcggttggagctgtatgcccaggccacagaagcgctgctgaagaccggagctgcttacccctgtttctgctcaccccagcggctggagctcctgaagaaggaggccttgcggaaccaccagacgccccggtatgacaatcggtgcaggaacatgagccaggagcaggtggcccagaagctggccaaggaccccaagcctgcgatccgcttccgcctggagcaggtggtgccagccttccaggacctggtctatggctggaataggcatgaagtggccagcgtggagggagacccagtcatcatgaagagcgacggcttccccacataccacctggcctgcgtggtggacgaccaccacatgggcatcagccacgtgctgcgaggctctgagtggctcgtctccactgccaagcacctgctcctctaccaggccctgggctggcagccaccccacttcgcccacctgcccctgctcctcaacagggatggcagcaagctctccaagaggcaaggggacgttttcctggagcactttgctgctgatggcttcctgcccgattccttgttggacatcatcaccaactgtggctcaggttttgcagagaaccaaatgggcaggaccctgccggagctgatcacacagttcaacctgacacaggtcacctgtcactcagccctgctggacctggagaagctcccagaattcaacagactgcacctccagcggctggtgagcaatgagagccagaggcgccagctggtggggaagctgcaggtccttgtggaggaggcctttggttgccagctgcaaaacagggatgtcctcaacccagtctacgtggagaggatcctcctgctgagacagggtcacatttgccgcctgcaggacttggtgtccccagtatactcttacctgtggactcgccctgcagtaggtcgagcacagctggacgccatctcggagaaggtggatgtgattgccaagcgtgtgctggggcttctagaaagatctagtatgagcttaactcaggatatgctgaatggagaactgaagaagctatcagaaggtctggaaggcaccaagtacagtaatgtgatgaaactccttcggatggccctcagtggacagcagcaaggacctcctgtagctgagatgatgttggccttgggaccaaaggaagtacgggaacggatccagaaggtggtttccagctagggagaggatgtttcgggcagtggagatcgccctaagaacctgtgagcttagaaacagctttcagagaccagaaggaggcctggggcccgtcgggaagtttgctgaaggaactaagagtggaaacaatctctgactgcacacaagtgcatttgtgatccaccacaggcacgtttttgtcaattggctggggaagcccaacccatctaacctcctggactctggaaaggcattctccgggtctggtttctcacacattacacagcagaggtttggagttagttcacagaaaagttaacatcccggaacagtgcagaaggcttgggtttcagtttgctagggcccccataacaaaatgccacagaaccaggtggtttaaacaacagagatttattttctcacatttggaggctagaagttcaagatcaaggtgtcagcaggcctggtttttcctagaggcctcttttgttggcttgcagacagctgtcttctcactgtgtccttgtgcggtcttccctccatgcacacacatctctaagtttcattatgtgcccaacgttcctcttctaagaacaccagttggactggattttaactttaaccagcctcatttaagttaatcacctctttaaatgctcaatctccaagtacagtctcattctgaggttccaggggtttctcaacgtaagaatttagggggacagaattcagcccgtagcagctgggcagcaggactcatgggtcccagttctcaggccccaaggactcagagcagcaaaggatacgtgacacaagcagggctgaactggacaccagactttctttggggttgtaaaaggagaagtgtgactccactgccaagggtaagcactcttgtcttatgctaccctttattcttgaaccttggggcagcctgtgtctcccttccctaaacgtcatctgttccgtttttccagtcttccagacctggtccttggactggagaccttcacccttcctattttgtggctttctcttcaaatccacctcgtccttcctccatgacttataagtcatcatctctgctggtttctgaaatgagatatgcttcttggggtcttcagtgaagaggaatagcaagtgaaaggaggatggtggcagggtacatgaacccctaccaggcttctaggcttcccctgcatggcagccagcctctaagttggcccccaaccatccctgccttcttctattcacacccttgtgtggttccttcccacattgaataggcctgacttgtgtaaccactacactattgaagaaatgagagtttgacttctgagggtaagtcataaaatacatcgtggcttctgtcttgttttctttgatcgcttactttgggggaagccagcttccaggtcatgaaaatactcaagcagccttatggagtgctccacatgacaagggatcgaggcctcccaccaatagccatgggagtgtgcaatcttgaaagctggtccttcaattccagccaagcattcacatgaccgcaatcctagctgatctcgcttgtgacctctatgggagaccctaagccagaaccactcagagaagctgctccggaacgtcagacacacatgaactgtgagatagtaaacgtttattgtttaaagctacttggtttggggataatttgcgtttcagcagtagacaatatatttattttgtccaggggagtggaaaggcgattacagagtttgttgagccccatagagtcctagtctttgcttaaagaaatataccagttctttctaatacagaatccattaagttcgttggttgcaaacaatagaaaccaactctgcctcacttatgtttattggaggccataagagagccacagcatctaccaaaaagccaaaaaaaaaacaggttttggaaaagacaggaactagctacaggagctaatggccaatcttgtctgagttctttgatggcgacacatgaactacagccgttttgttgttgttaatttctccgtgttttcccctcagttttggatgactctgctcaaggttcagattctgaggagcaagtatctgttgggctatctgaggtcctgctaccattccttggccagtaataggtagtttcacagggattatatgcaatggaggaaaagttgttctcaaggaaaactagggagctttctccagaagatgatgtaatggcagaaacaacaggtggttgaccacagaaggggacaataataatacttgtaatttattgtgcgcttatatgagcctcaccctctcccaggtgtcagataatgctcgtaaatgccttagtccatcatctcagtaaattttttttataacactatg

SEQ ID NO: 137695 - DNA, 533 bp, Homo sapiens
  Payload ID: 6962
  Gene Symbol: EARS2
  Gene Name: glutamyl-tRNA synthetase 2, mitochondrial
  ENST ID: ENST00000562581
  CDS Start-End: 11-175
tccatcccacatggcggcgctcctgaggagactgctgcagcgcgagaggccttcggcggcctctggccgccccgtaggacggcgcgaggccaacctgggcactgatgccggggttgcggtgcgagtgcggttcgctcccagccccacaggtgttgtagacgctgggatacagtgatcattgagaaaggcttcttgcacctgggtggcctccgcactgccttgtacaactacatctttgctaagaagtaccaggggagcttcatcctgaggctagaggacacagatcagactcgcgttgtgcctggggcagcggagaatattgaggacatgctggagtgggcaggcatcccgcctgatgagagcccccgccggggcggtcctgctgggccctaccagcaatctcagcggttggagctgtatgcccaggccacagaagcgctgctgaagaccggagctgcttacccctgtttctgctcaccccagcggctggagctcctgaagaaggaggccttgcggaaccaccagacgccccg

SEQ ID NO: 137696 - DNA, 627 bp, Homo sapiens
  Payload ID: 6962
  Gene Symbol: EARS2
  Gene Name: glutamyl-tRNA synthetase 2, mitochondrial
  ENST ID: ENST00000564668
  CDS Start-End: 22-321
acgtgtgctattccatcccacatggcggcgctcctgaggagactgctgcagcgcgagaggccttcggcggcctctggccgccccgtaggacggcgcgaggccaacctgggcactgatgccggggttgcggtgcgagtgcggttcgctcccagccccacagagtctcactctactgctgcccaggctggagtgcagaggcgtgatcatggctcgctgcagcctcagcgtccccaggctcaggcttcttgcacctgggtggcctccgcactgccttgtacaactacatctttgctaagaagtaccaggggagcttcatcctgaggctagaggacacagatcagactcgcgttgtgcctggggcagcggagaatattgaggacatgctggagtgggcaggcatcccgcctgatgagagcccccgccggggcggtcctgctgggccctaccagcaatctcagcggttggagctgtatgcccaggccacagaagcgctgctgaagaccggagctgcttacccctgtttctgctcaccccagcggctggagctcctgaagaaggaggccttgcggaaccaccagacgccccggtatgacaatcggtgcaggaacatgagccaggagcaggtgg

SEQ ID NO: 137697 - DNA, 572 bp, Homo sapiens
  Payload ID: 6962
  Gene Symbol: EARS2
  Gene Name: glutamyl-tRNA synthetase 2, mitochondrial
  ENST ID: ENST00000564997
  CDS Start-End: 22-261
acgtgtgctattccatcccacatggcggcgctcctgaggagactgctgcagcgcgagaggccttcggcggcctctggccgccccgtaggacggcgcgaggccaacctgggcactgatgccggggttgcggtgcgagtgcggttcgctcccagccccacagagtctcactctactgctgcccaggctggagtgcagaggcgtgatcatggctcgctgcagcctcagcgtccccaggctcaggtgatcctcccacctcagtaactgaaaccacaggcatgcttcttgcacctgggtggcctccgcactgccttgtacaactacatctttgctaagaagtaccaggggagcttcatcctgaggctagaggacacagatcagactcgcgttgtgcctggggcagcggagaatattgaggacatgctggagtgggcaggcatcccgcctgatgagagcccccgccggggcggtcctgctgggccctaccagcaatctcagcggttggagctgtatgcccaggccacagaagcgctgctgaagaccggagctgcttacccctgtttctgctcacccca

SEQ ID NO: 137698 - DNA, 1709 bp, Homo sapiens
  Payload ID: 6962
  Gene Symbol: EARS2
  Gene Name: glutamyl-tRNA synthetase 2, mitochondrial
  Uniprot ID: Q5JPH6
  ENST ID: ENST00000563232
  CDS Start-End: 2-1606
catggcggcgctcctgaggagactgctgcagcgcgagaggccttcggcggcctctggccgccccgtaggacggcgcgaggccaacctgggcactgatgccggggttgcggtgcgagtgcggttcgctcccagccccacaggcttcttgcacctgggtggcctccgcactgccttgtacaactacatctttgctaagaagtaccaggggagcttcatcctgaggctagaggacacagatcagactcgcgttgtgcctggggcagcggagaatattgaggacatgctggagtgggcaggcatcccgcctgatgagagcccccgccggggcggtcctgctgggccctaccagcaatctcagcggttggagctgtatgcccaggccacagaagcgctgctgaagaccggagctgcttacccctgtttctgctcaccccagcggctggagctcctgaagaaggaggccttgcggaaccaccagacgccccggtatgacaatcggtgcaggaacatgagccaggagcaggtggcccagaagctggccaaggaccccaagcctgcgatccgcttccgcctggagcaggtggtgccagccttccaggacctggtctatggctggaataggcatgaagtggccagcgtggagggagacccagtcatcatgaagagcgacggcttccccacataccacctggcctgcgtggtggacgaccaccacatgggcatcagccacgtgctgcgaggctctgagtggctcgtctccactgccaagcacctgctcctctaccaggccctgggctggcagccaccccacttcgcccacctgcccctgctcctcaacagggatggcagcaagctctccaagaggcaaggggacgttttcctggagcactttgctgctgatggcttcctgcccgattccttgttggacatcatcaccaactgtggctcaggttttgcagagaaccaaatgggcaggaccctgccggagctgatcacacagttcaacctgacacaggtcacctgtcactcagccctgctggacctggagaagctcccagaattcaacagactgcacctccagcggctggtgagcaatgagagccagaggcgccagctggtggggaagctgcaggtccttgtggaggaggcctttggttgccagctgcaaaacagggatgtcctcaacccagtctacgtggagaggatcctcctgctgagacagggtcacatttgccgcctgcaggacttggtgtccccagtatactcttacctgtggactcgccctgcagtaggtcgagcacagctggacgccatctcggagaaggtggatgtgattgccaagcgtgtgctggggcttctagaaagatctagtatgagcttaactcaggatatgctgaatggagaactgaagaagctatcagaaggtctggaaggcaccaagtacagtaatgtgatgaaactccttcggatggccctcagtggacagcaggtgaggcagggacacgggttggattgttccctggagcccctcattgatcctttgaacttacatttcctggcaggcactgagctcaatattgagtatacaaaggtgaatgaaacatgatcactcccctcatttagtcaatcaacagacactattgagtacctactatgtgcaagcattgtgttaggtacagtgaatacaatatagaattaaacacacatac

SEQ ID NO: 137699 - DNA, 3840 bp, Homo sapiens
  Payload ID: 6962
  Gene Symbol: EARS2
  Gene Name: glutamyl-tRNA synthetase 2, mitochondrial
  Uniprot ID: Q5JPH6
  ENST ID: ENST00000563459
  CDS Start-End: 8-1579
atcccacatggcggcgctcctgaggagactgctgcagcgcgagaggccttcggcggcctctggccgccccgtaggacggcgcgaggccaacctgggcactgatgccggggttgcggtgcgagtgcggttcgctcccagccccacaggcttcttgcacctgggtggcctccgcactgccttgtacaactacatctttgctaagaagtaccaggggagcttcatcctgaggctagaggacacagatcagactcgcgttgtgcctggggcagcggagaatattgaggacatgctggagtgggcaggcatcccgcctgatgagagcccccgccggggcggtcctgctgggccctaccagcaatctcagcggttggagctgtatgcccaggccacagaagcgctgctgaagaccggagctgcttacccctgtttctgctcaccccagcggctggagctcctgaagaaggaggccttgcggaaccaccagacgccccggtatgacaatcggtgcaggaacatgagccaggagcaggtggcccagaagctggccaaggaccccaagcctgcgatccgcttccgcctggagcaggtggtgccagccttccaggacctggtctatggctggaataggcatgaagtggccagcgtggagggagacccagtcatcatgaagagcgacggcttccccacataccacctggcctgcgtggtggacgaccaccacatgggcatcagccacgtgctgcgaggctctgagtggctcgtctccactgccaagcacctgctcctctaccaggccctgggctggcagccaccccacttcgcccacctgcccctgctcctcaacagggatggcagcaagctctccaagaggcaaggggacgttttcctggagcactttgctgctgatggcttcctgcccgattccttgttggacatcatcaccaactgtggctcaggttttgcagagaaccaaatgggcaggaccctgccggagctgatcacacagttcaacctgacacaggtcacctgtcactcagccctgctggacctggagaagctcccagaattcaacagactgcacctccagcggctggtgagcaatgagagccagaggcgccagctggtggggaagctgcaggtccttgtggaggaggcctttggttgccagctgcaaaacagggatgtcctcaacccagtctacgtggagaggatcctcctgctgagacagggtcacatttgccgcctgcaggacttggtgtccccagtatactcttacctgtggactcgccctgcagtaggtcgagcacagctggacgccatctcggagaaggtggatgtgattgccaagcgtgtgctggggcttctagaaagatctagtatgagcttaactcaggatatgctgaatggagaactgaagaagctatcagaaggtctggaaggcaccaagtacagtaatgtgatgaaactccttcggatggccctcagtggacagcagcaaggacctcctgtagctgagatgatgttggccttgggaccaaaggaagtacgggaacggatccagaaggtggtttccagctagggagaggatgtttcgggcagtggagatcgccctaagaacctgtgagcttagaaacagctttcagagaccagaaggaggcctggggcccgtcgggaagtttgctgaaggaactaagagtggaaacaatctctgactgcacacaagtgcatttgtgatccaccacaggcacgtttttgtcaattggctggggaagcccaacccatctaacctcctggactctggaaaggcattctccgggtctggtttctcacacattacacagcagaggtttggagttagttcacagaaaagttaacatcccggaacagtgcagaaggcttgggtttcagtttgctagggcccccataacaaaatgccacagaaccaggtggtttaaacaacagagatttattttctcacatttggaggctagaagttcaagatcaaggtgtcagcaggcctggtttttcctagaggcctcttttgttggcttgcagacagctgtcttctcactgtgtccttgtgcggtcttccctccatgcacacacatctctaagtttcattatgtgcccaacgttcctcttctaagaacaccagttggactggattttaactttaaccagcctcatttaagttaatcacctctttaaatgctcaatctccaagtacagtctcattctgaggttccaggggtttctcaacgtaagaatttagggggacagaattcagcccgtagcagctgggcagcaggactcatgggtcccagttctcaggccccaaggactcagagcagcaaaggatacgtgacacaagcagggctgaactggacaccagactttctttggggttgtaaaaggagaagtgtgactccactgccaaggtcttccagacctggtccttggactggagaccttcacccttcctattttgtggctttctcttcaaatccacctcgtccttcctccatgacttataagtcatcatctctgctggtttctgaaatgagatatgcttcttggggtcttcagtgaagaggaatagcaagtgaaaggaggatggtggcagggtacatgaacccctaccaggcttctaggcttcccctgcatggcagccagcctctaagttggcccccaaccatccctgccttcttctattcacacccttgtgtggttccttcccacattgaataggcctgacttgtgtaaccactacactattgaagaaatgagagtttgacttctgagggtaagtcataaaatacatcgtggcttctgtcttgttttctttgatcgcttactttgggggaagccagcttccaggtcatgaaaatactcaagcagccttatggagtgctccacatgacaagggatcgaggcctcccaccaatagccatgggagtgtgcaatcttgaaagctggtccttcaattccagccaagcattcacatgaccgcaatcctagctgatctcgcttgtgacctctatgggagaccctaagccagaaccactcagagaagctgctccggaacgtcagacacacatgaactgtgagatagtaaacgtttattgtttaaagctacttggtttggggataatttgcgtttcagcagtagacaatatatttattttgtccaggggagtggaaaggcgattacagagtttgttgagccccatagagtcctagtctttgcttaaagaaatataccagttctttctaatacagaatccattaagttcgttggttgcaaacaatagaaaccaactctgcctcacttatgtttattggaggccataagagagccacagcatctaccaaaaagccaaaaaaaaaacaggttttggaaaagacaggaactagctacaggagctaatggccaatcttgtctgagttctttgatggcgacacatgaactacagccgttttgttgttgttaatttctccgtgttttcccctcagttttggatgactctgctcaaggttcagattctgaggagcaagtatctgttgggctatctgaggtcctgctaccattccttggccagtaataggtagtttcacagggattatatgcaatggaggaaaagttgttctcaaggaaaactagggagctttctccagaagatgatgtaatggcagaaacaacaggtggttgaccacagaaggggacaataataatacttgtaatttattgtgcgcttatatgagcctcaccctctcccaggtgtcagataatgctcgtaaatgccttagtccatcatctcagtaaattttttttataacact

SEQ ID NO: 137700 - DNA, 2027 bp, Homo sapiens
  Payload ID: 6962
  Gene Symbol: EARS2
  Gene Name: glutamyl-tRNA synthetase 2, mitochondrial
  ENST ID: ENST00000564501
  CDS Start-End: 389-1909
acaacacccaccgctcccgcagaggccgctgggaagaggcgagctggctgagattggcccccgcagcagcccctaatctctcacagcccggccggaaacaggtggaggtttctatggagacccgcctcctccgctcccaggtccggcccctgccacgctttcgctttcccaagctgaagggggcgggtccgggaaatagccctttctctggcctctgccccctggtggcgagtgcggccgcagccgtccaggggggcgtgggatttcgcgctagggggcctgtgactttaaggggcaaggctgcgctggctgtggcggaggccgattggctggaagcagtccccggaagtgacgcagggagaagcccacgtgtgctattccatcccacatggcggcgctcctgaggagactgctgcagcgcgagaggccttcggcggcctctggccgccccgtaggacggcgcgaggccaacctgggcactgatgccggggttgcggtgcgagtgcggttcgctcccagccccacaggcttcttgcacctgggtggcctccgcactgccttgtacaactacatctttgctaagaagtaccaggggagcttcatcctgaggctagaggacacagatcagactcgcgttgtgcctggggcagcggagaatattgaggacatgctggagtgggcaggcatcccgcctgatgagagcccccgccggggcggtcctgctgggccctaccagcaatctcagcggttggagctgtatgcccaggccacagaagcgctgctgaagaccggagctgcttacccctgtttctgctcaccccagcggctggagctcctgaagaaggaggccttgcggaaccaccagacgccccggtatgacaatcggtgcaggaacatgagccaggagcaggtggcccagaagctggccaaggaccccaagcctgcgatccgcttccgcctggagcaggtggtgccagccttccaggacctggtctatggctggaataggcatgaagtggccagcgtggagggagacccagtcatcatgaagagcgacggcttccccacataccacctggcctgcgtggtggacgaccaccacatgggcatcagccacgtgctgcgaggctctgagtggctcgtctccactgccaagcacctgctcctctaccaggccctgggctggcagccaccccacttcgcccacctgcccctgctcctcaacagggatggcagcaagctctccaagaggcaaggggacgttttcctggagcactttgctgctgatggcttcctgcccgattccttgttggacatcatcaccaactgtggctcaggttttgcagagaaccaaatgggcaggaccctgccggagctgatcacacagttcaacctgacacaggtcacctgtcactcagccctgctggacctggagaagctcccagaattcaacagactgcacctccagcggctggtgagcaatgagagccagaggcgccagctggtggggaagctgcaggtccttgtggaggaggcctttggttgccagctgcaaaacagggatgtcctcaacccagtctacgtggagaggatcctcctgctgagacagggtcacatttgccgcctgcaggacttggtgtccccagtatactcttacctgtggactcgccctgcagtaggtcgagcacagctggacgccatctcggagaaggtggatgtgattgccaagcgtgtgctggggcttctagaaagatctagtatgagcttaactcaggatatgctgaatggagaactgaagaagctatcagaaggtctggaaggcaccaagtacagtaatgtgatgaaactccttcggatggccctcagtggacagcaggcactgagctcaatattgagtatacaaaggtgaatgaaacatgatcactcccctcatttagtcaatcaacagacactattgagtacctactatgtgcaagcattgtgttaggtacagtgaatacaatatagaattaaacacacatacataa

SEQ ID NO: 137701 - DNA, 556 bp, Homo sapiens
  Payload ID: 6962
  Gene Symbol: EARS2
  Gene Name: glutamyl-tRNA synthetase 2, mitochondrial
  ENST ID: ENST00000563499
  CDS Start-End: 13-351
attccatcccacatggcggcgctcctgaggagactgctgcagcgcgagaggccttcggcggcctctggccgccccgccgaggccccctgtcccgtctccgccccacgaatgttcccgaatgaatcctttccggtggtgtcagagtgggcgggcggaggagggttaaggcagcgcgagcccattttacagaggcggaaactgaggtgcaggagcggaaataattcaaattgccaggagtttcttgtgttttttgtgccatcccatctctttcgatctttttttcatgcattccatacatgtgcattgatgacaacctgtgtaacaggtgttgtagacgctgggatacagtgatcattgagaaagagtctcactctactgctgcccaggctggagtgcagaggcgtgatcatggctcgctgcagcctcagcgtccccaggctcaggcttcttgcacctgggtggcctccgcactgccttgtacaactacatctttgctaagaagtaccaggggagcttcatcctgaggctagaggacacagatcagactcgcgttgtg

SEQ ID NO: 137702 - DNA, 2385 bp, Homo sapiens
  Payload ID: 6963
  Gene Symbol: GATB
  Gene Name: glutamyl-tRNA(Gln) amidotransferase, subunit B
  Uniprot ID: O75879
  ENST ID: ENST00000263985
  CDS Start-End: 42-1715
atagtgaggctgagtcacctgaccaagaccctggagttacaatggcggcgcccatgctgcgctggggctgccgtggaagacgttgggctttcgcccgggttgacggtggttcttgccaccgaagaggggctccgactgggtccacatccaaccagattaggggagagagctcagtggctcagcagcccctccacacggcccagaagacgaggaaaggtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccggttctcaacaggaggtgtgtagaagcggcggtgatgacaggcctggctctgaactgccacataaacaagaagtccttgtttgacaggaagcactacttctatgcagacctccctgcaggctaccaaattacccagcagaggctcccaattgctgtgaatgggagcttgatatatggcgtctgtgcagggaagaagcagagtcaggtgatccccaagacggtgaggatcaagcagatccagttggagcaagacagtggcaaaagcctccacgacaacctgaggtctcagacgctcattgatttgaacagggcaggagtgggccttctggaggtggtcctggagcccgacatgtcctgtggagaagaggcggcaacagctgtcagggagctgcagctgatccttcaagccctggggaccagccaggcgaacatggcagagggccagttgagagtggatgccaatatatccgtgcatcaccctggggagcctttgggcgttcgaacggaagtgaagaatctcaacagcatcaggttcctggccaaagccatagactatgaaattcagaggcaaatcaatgaacttgagaatggaggtgaaattctgaacgaaacacgctcatttcatcacaagctggggtgcaccatgtcaatgagagacaaagaaggaaaacaggactacaggttcatgccagaacccaacctgcctcccctggtgctctacgacgccacatctctgcccgcaggtgcagacccacagcaagtgatcaatattgaccagattcgggagacactcccggagctccccagtgtgacccgagagaagcttgtccaacagtatgggatgctgctggaacacagcttcactttgctgaacgaagtcggcctactggagttcttccaaaatgtgataaaagaaactagggcagagccaaaaaaggtgactagttgggtcctcaacacttttctgggctatttaaagcaacagaacctcgctgtcagtgagagtcctgtcacaccctctgcactcgctgagcttcttgacctgctggacagcagaacaatttcttcatcagcagctaaacaggtgtttgaggaactgtggaagagggaaggcaagactccagggcagattgtttcagaaaagcagcttgaactgatgcaggaccagggggcactggagcagctctgccactctgtgatggaggcccatcctcaagtggtaatggatgtgaagaacagaaaccccagagctataaataaactgattgggttggtccggaaagcgactcaaagccgagcagatccagtcatgataaaggagatcctggagaagaagctgtcattgtgagatgtttgggatccccttgcccaagggacaacaacaaacagtgcagcctgactgggaacaggatcctgtgaaagctgatgcccatgtgccctgagagctgcctctcaatccctgtcccaagccacagctatggcattaatgtcaccagtgttctcaccctctaggccctgtgcctggaggtgcctccacagccgaccagcagccaccccgcctgcttcatccacatcaggagggtccggtgaggctgcagcagtggttaaggagtaacaccttcttgtattaaggaattttaaactaaataaaatgtatgttggagatactgttacccattctaagaaaacttttcattctgcagttccttcaacaaatatttttgagcaactcctaagggccagccattgtaggtgatgggcattagcagtggtcaagagagactgtaatttggatgtattgttttcagacctaaacacaggttaacaaagatgaaaatacaaccaaataaactggcacagtataaacacatttgtttgtttaaggaggtctcaagagggtggggaaggaggatattattagaattaatcaacctatcgactgagtagaagtgatattgcctgttaaactccctccccatcccagaaggcacagtctgagaataaatgaattaaaaaaa

SEQ ID NO: 137703 - DNA, 1519 bp, Homo sapiens
  Payload ID: 6963
  Gene Symbol: GATB
  Gene Name: glutamyl-tRNA(Gln) amidotransferase, subunit B
  ENST ID: ENST00000512306
  CDS Start-End: 4-1077
acaatggcggcgcccatgctgcgctggggctgccgtggaagacgttgggctttcgcccgggttgacggtggttcttgccaccgaagaggggctccgactgggtccacatccaaccagattaggggagagagctcagtggctcagcagcccctccacacggcccagaagacgaggaaaggtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccggttctcaacaggaggtgtgtagaagcggcggtgatgacaggcctggctctgaactgccacataaacaagaagtccttgtttgacaggaagcactacttctatgcagacctccctgcaggctaccaaattacccagcagaggctcccaattgctgtgaatgggagcttgatatatggcgtctgtgcagggaagaagcagagtcaggtgatccccaagacggtgaggatcaagcagatccagttggagcaagacagtggcaaaagcctccacgacaacctgaggtctcagacgctcattgatttgaacagggcaggagtgggccttctggaggtggtcctggagcccgacatgtcctgtggagaagaggcggcaacagctgtcagggagctgcagctgatccttcaagccctggggaccagccaggcgaacatggcagagggccagttgagagtggatgccaatatatccgtgcatcaccctggggagcctttgggcgttcgaacggaagtgaagaatctcaacagcatcaggttcctggccaaagccatagactatgaaattcagaggcaaatcaatgaacttgagaatggaggtgaaattctgaacgaaacacgctcatttcatcacaagctggggtgcaccatgtcaatgagagacaaagaaggaaaacaggactacaggtggttactccttatggcaaaataccgctatatatcgggggctggggcgtatttcaagttcatttaaagttcaacataatgatcctgaacaatttttagaaaccactttttgtcattgttgtaacatgatgggacatctagacttcctctttgatatgcataccgagagaagtactagtttcttgatttggtagcctcagatctggtgccttgtttgactgattcagcttttggaagaacttgttcatccactgctgtgtcaaagttgtcatagttgagctaggaggatggctgtagaggttggggcctaggctgttcttattctaatgttcagtaactgattcagtaatacgctgaatgaagctccttgagaagaaatgagaaaagagatgttgatagcgtatgttgatggtagttcccttgaacctcatatgatgctatttcatgataaattaagttgaactacttaatatgagacccacaaataaagcaaatgctaagaacaggca

SEQ ID NO: 137704 - DNA, 1860 bp, Homo sapiens
  Payload ID: 6963
  Gene Symbol: GATB
  Gene Name: glutamyl-tRNA(Gln) amidotransferase, subunit B
  ENST ID: ENST00000503160
  CDS Start-End: 1-410
cccgggttgacggtggttcttgccaccgaagaggggctccgactgggtccacatccaaccagattaggggagagagctcagtggctcagcagcccctccacacggcccagaagacgaggaaaggtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccggttctcaacaggaggtgtgtagaagcggcggtgatgacaggcctggctctgaactgccacataaacaagaagtccttgtttgacaggaagcactacttctatgcagacctccctggaagaagcagagtcaggtgatccccaagacggtgaggatcaagcagatccagttggagcaagacagtggcaaaagcctccacgacaacctgaggtctcagacgctcattgatttgaacagggcaggagtgggccttctggaggtggtcctggagcccgacatgtcctgtggagaagaggcggcaacagctgtcagggagctgcagctgatccttcaagccctggggaccagccaggcgaacatggcagagggccagttgagagtggatgccaatatatccgtgcatcaccctggggagcctttgggcgttcgaacggaagtgaagaatctcaacagcatcaggttcctggccaaagccatagactatgaaattcagaggcaaatcaatgaacttgagaatggaggtgaaattctgaacgaaacacgctcatttcatcacaagctggggtgcaccatgtcaatgagagacaaagaaggaaaacaggactacaggttcatgccagaacccaacctgcctcccctggtgctctacgacgccacatctctgcccgcaggtgcagacccacagcaagtgatcaatattgaccagattcgggagacactcccggagctccccagtgtgacccgagagaagcttgtccaacagtatgggatgctgctggaacacagcttcactttgctgaacgaagtcggcctactggagttcttccaaaatgtgataaaagaaactagggcagagccaaaaaaggtgactagttgggtcctcaacacttttctgggctatttaaagcaacagaacctcgctgtcagtgagagtcctgtcacaccctctgcactcgctgagcttcttgacctgctggacagcagaacaatttcttcatcagcagctaaacaggtgtttgaggaactgtggaagagggaaggcaagactccagggcagattgtttcagaaaagcagcttgaactgatgcaggaccagggggcactggagcagctctgccactctgtgatggaggcccatcctcaagtggtaatggatgtgaagaacagaaaccccagagctataaataaactgattgggttggtccggaaagcgactcaaagccgagcagatccagtcatgataaaggagatcctggagaagaagctgtcattgtgagatgtttgggatccccttgcccaagggacaacaacaaacagtgcagcctgactgggaacaggatcctgtgaaagctgatgcccatgtgccctgagagctgcctctcaatccctgtcccaagccacagctatggcattaatgtcaccagtgttctcaccctctaggccctgtgcctggaggtgcctccacagccgaccagcagccaccccgcctgcttcatccacatcaggagggtccggtgaggctgcagcagtggttaaggagtaacaccttcttgtattaaggaattttaaactaaataaaatgtatgt

SEQ ID NO: 137705 - DNA, 605 bp, Homo sapiens
  Payload ID: 6963
  Gene Symbol: GATB
  Gene Name: glutamyl-tRNA(Gln) amidotransferase, subunit B
  ENST ID: ENST00000508611
  CDS Start-End: 9-356
gagttacaatggcggcgcccatgctgcgctggggctgccgtggaagacgttgggctttcgcccgggttgacggtggttcttgccaccgaagaggggctccgactgggtccacatccaaccagattaggggagagagctcagtggctcagcagcccctccacacggcccagaagacgaggaaaggtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccgagtgaagacagcccaagttgaattttcccattctgtatcctatcctcagaacatgctgacctggacttccatctgtcacaagcagcttgactaagatcctaggaaattcctttttttcttggcattcttctaactgacactctctgtttactgggccctctgtgcatctgtaacgtgtgatgactgatgcttataattctgaccttgaagtacttcatggcttctaaatcatcaaaaaaagattaaagcatattctcagtatcactgtaa

SEQ ID NO: 137706 - DNA, 1345 bp, Homo sapiens
  Payload ID: 6963
  Gene Symbol: GATB
  Gene Name: glutamyl-tRNA(Gln) amidotransferase, subunit B
  ENST ID: ENST00000511538
  CDS Start-End: 1-441
atgctgcgctggggctgccgtggaagacgttgggctttcgcccgggttgacggtggttcttgccaccgaagaggggctccgactgggtccacatccaaccagattaggggagagagctcagtggctcagcagcccctccacacggcccagaagacgaggaaaggtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccggttctcaacaggaggtgtgtagaagcggcggtgatgacaggcctggctctgaactgccacataaacaagaagtccttgtttgacaggaagcactacttctatgcagacctccctagggccagttgagagtggatgccaatatatccgtgcatcaccctggggagcctttgggcgttcgaacggaagtgaagaatctcaacagcatcaggttcctggccaaagccatagactatgaaattcagaggcaaatcaatgaacttgagaatggaggtgaaattctgaacgaaacacgctcatttcatcacaagctggggtgcaccatgtcaatgagagacaaagaaggaaaacaggactacaggtggttactccttatggcaaaataccgctatatatcgggggctggggcgtatttcaagttcatttaaagttcaacataatgatcctgaacaatttttagaaaccactttttgtcattgttgtaacatgatgggacatctagacttcctctttgatatgcataccgagagaagtactagtttcttgatttggtagcctcagatctggtgccttgtttgactgattcagcttttggaagaacttgttcatccactgctgtgtcaaagttgtcatagttgagctaggaggatggctgtagaggttggggcctaggctgttcttattctaatgttcagtaactgattcagtaatacgctgaatgaagctccttgagaagaaatgagaaaagagatgttgatagcgtatgttgatggtagttcccttgaacctcatatgatgctatttcatgataaattaagttgaactacttaatatgagacccacaaataaagcaaatgctaagaacaggcataagataattgaaacttttatttttttctcattgagtttagcaggttgaagttttaagcaacaaagttgtgagatcggccacctttcctttgtgaagggcagaaagatgcaaatgtagctattatcaatgaggatcaaaatttgcatgtttatgtgggaaaga

SEQ ID NO: 137707 - DNA, 779 bp, Homo sapiens
  Payload ID: 6963
  Gene Symbol: GATB
  Gene Name: glutamyl-tRNA(Gln) amidotransferase, subunit B
  ENST ID: ENST00000515884
  CDS Start-End: 1-424
ccgtggaagacgttgggctttcgcccgggttgacggtggttcttgccaccgaagaggggctccgactgggtccacatccaaccagattaggggagagagctcagtggctcagcagcccctccacacggcccagaagacgaggaaaggtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccggttctcaacaggaggtgtgtagaagcggcggtgatgacaggcctggctctgaactgccacataaacaagaagtccttgtttgacaggaagcactacttctatgcagacctccctagggccagttgagagtggatgccaatatatccgtgcatcaccctggggagcctttgggcgttcgaacggaagtgaagaatctcaacagcatcaggttcctggccaaagccatagactatgaaattcagaggcaaatcaatgaacttgagaatggaggtgaaattctgaacgaaacacgctcatttcatcacaagctggggtgcaccatgtcaatgagagacaaagaaggaaaacaggactacaggttcatgccagaacccaacctgcctcccctggtgctctacgacgccacatctctgcccgcaggtgcagacccacagcaagtgatcaatattgaccagattcgggagacactcccggagctccc

SEQ ID NO: 137708 - DNA, 874 bp, Homo sapiens
  Payload ID: 6963
  Gene Symbol: GATB
  Gene Name: glutamyl-tRNA(Gln) amidotransferase, subunit B
  ENST ID: ENST00000510720
  CDS Start-End: 1-397
gttcatgccagaacccaacctgcctcccctggtgctctacgacgccacatctctgcccgcaggtgcagacccacagcaagtgatcaatattgaccagattcgggagacactcccggagctccccagtgtgacccgagagaagcttgtccaacagtatgggatgctgctggaacacagcttcactttgctgaacgaagtcggcctactggagttcttccaaaatgtgataaaagaaactagggcagagccaaaaaaggtgactagttgggtcctcaacacttttctgggctatttaaagcaacagaacctcgctgtcagtgagaggtgtttgaggaactgtggaagagggaaggcaagactccagggcagattgtttcagaaaagcagcttgaactgatgcaggaccagggggcactggagcagctctgccactctgtgatggaggcccatcctcaagtggtaatggatgtgaagaacagaaaccccagagctataaataaactgattgggttggtccggaaagcgactcaaagccgagcagatccagtcatgataaaggagatcctggagaagaagctgtcattgtgagatgtttgggatccccttgcccaagggacaacaacaaacagtgcagcctgactgggaacaggatcctgtgaaagctgatgcccatgtgccctgagagctgcctctcaatccctgtcccaagccacagctatggcattaatgtcaccagtgttctcaccctctaggccctgtgcctggaggtgcctccacagccgaccagcagccaccccgcctgcttcatccacatcaggagggtccggtgaggctgcagcagtggttaaggagtaacaccttcttgtattaagga

SEQ ID NO: 137709 - DNA, 1893 bp, Homo sapiens
  Payload ID: 6963
  Gene Symbol: GATB
  Gene Name: glutamyl-tRNA(Gln) amidotransferase, subunit B
  ENST ID: ENST00000515812
  CDS Start-End: 18-1568
aagaccctggagttacaatggcggcgcccatgctgcgctggggctgccgtggaagacgttgggctttcgcccgggttgacggtggttcttgccaccgaagaggggctccgactgggtccacatccaaccagattaggggagagagctcagtggctcagcagcccctccacacggcccagaagacgaggaaaggtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccggttctcaacaggaggtgtgtagaagcggcggtgatgacaggcctggctctgaactgccacataaacaagaagtccttgtttgacaggaagcactacttctatgcagacctccctgcaggctaccaaattacccagcagaggctcccaattgctgtgaatgggagcttgatatatggcgtctgtgcagggaagaagcagagtcaggtgatccccaagacggtgaggatcaagcagatccagttggagcaagacagtggcaaaagcctccacgacaacctgaggtctcagacgctcattgatttgaacagggcagagggccagttgagagtggatgccaatatatccgtgcatcaccctggggagcctttgggcgttcgaacggaagtgaagaatctcaacagcatcaggttcctggccaaagccatagactatgaaattcagaggcaaatcaatgaacttgagaatggaggtgaaattctgaacgaaacacgctcatttcatcacaagctggggtgcaccatgtcaatgagagacaaagaaggaaaacaggactacaggttcatgccagaacccaacctgcctcccctggtgctctacgacgccacatctctgcccgcaggtgcagacccacagcaagtgatcaatattgaccagattcgggagacactcccggagctccccagtgtgacccgagagaagcttgtccaacagtatgggatgctgctggaacacagcttcactttgctgaacgaagtcggcctactggagttcttccaaaatgtgataaaagaaactagggcagagccaaaaaaggtgactagttgggtcctcaacacttttctgggctatttaaagcaacagaacctcgctgtcagtgagagtcctgtcacaccctctgcactcgctgagcttcttgacctgctggacagcagaacaatttcttcatcagcagctaaacaggtgtttgaggaactgtggaagagggaaggcaagactccagggcagattgtttcagaaaagcagcttgaactgatgcaggaccagggggcactggagcagctctgccactctgtgatggaggcccatcctcaagtggtaatggatgtgaagaacagaaaccccagagctataaataaactgattgggttggtccggaaagcgactcaaagccgagcagatccagtcatgataaaggagatcctggagaagaagctgtcattgtgagatgtttgggatccccttgcccaagggacaacaacaaacagtgcagcctgactgggaacaggatcctgtgaaagctgatgcccatgtgccctgagagctgcctctcaatccctgtcccaagccacagctatggcattaatgtcaccagtgttctcaccctctaggccctgtgcctggaggtgcctccacagccgaccagcagccaccccgcctgcttcatccacatcaggagggtccggtgaggctgcagcagtggttaaggagtaacaccttcttgtattaaggaattttaaactaaataaaatgtatgttggagatactgtta

SEQ ID NO: 137710 - DNA, 372 bp, Homo sapiens
  Payload ID: 6964
  Gene Symbol: GATC
  Gene Name: glutamyl-tRNA(Gln) amidotransferase, subunit C
  ENST ID: ENST00000229384
  CDS Start-End: 231-372
atctaggcgggtggcggagcaagccgggaggcacttcggagcgccggtgacccacactccccgcctcatccctcctccagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacagatgtctatacctgagatccgacaatgtggtagaaggcaactgtgctgatgaattactacaaaactcccatcgcgtcgtggaggagtactttgtggcccccccaggtaatatctctttgc

SEQ ID NO: 137711 - DNA, 4244 bp, Homo sapiens
  Payload ID: 6964
  Gene Symbol: GATC
  Gene Name: glutamyl-tRNA(Gln) amidotransferase, subunit C
  Uniprot ID: O43716
  ENST ID: ENST00000551765
  CDS Start-End: 44-454
ggcgttacgcgcgggcgcactgcgggggccaaggaaggaagaaatgtggtcgcggttggtgtggctgggccttcgggcccctctgggcgggcgccagggcttcacctccaaggcggatcctcagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacagatgtctatacctgagatccgacaatgtggtagaaggcaactgtgctgatgaattactacaaaactcccatcgcgtcgtggaggagtactttgtggcccccccaggtaatatctctttgccaaagctggatgaacaagagccattcccacacagctgagtagctcattctggaaagggggtactctgtgaacatgtggaagcataatgacagtatttttttactgtgaatactaatgttcctgcttttttcagtcccctgaaaaaatggatgctcaagcatttcttaataacagattcttctgaagacagaattgggaaagatctggccccaacaaggcagtgagttcctgatgctaactgaggtgaaagaaaagcaaaagtcagcttccaaggaattcacttaacaggcctgttcagtatggaagacattatttatctgcctttaactccccccaaaggaccataccaactgcatgaaagtgaacttttctatctacgtaactggtagacggagcatcttgatcactatgtgacaaccttggctgtcatttttagttgccatttgcattgatttgagcagccctatctttaccgaacatacctgaatttgttcctgggctcccactttcttcccagaagagggctaacttcctactaaggtctgaagagtgttgaaagtagactagagcttgggaactcctaacctagaactatctgccatcccacaaagtgattatatgccaaagggatactagtcatacctagtgtttctctttctgaaaagagaacttatcctaaaattagccctgggcctgggacaaaggagccctctccgcccccaaaatgattattaaattgagatgagtccaggataaaactcagataccaaggataaatgaaacttatttagggataaaagtgggctgggcgcagtggctcactcctgtaatcccagcactttgggaggctgagacgggcggatcacaaggtcaggagatcaagaccatcctggctaatgcggtgaaacctcatctctactaaaaatacaaaaaattagctgggtgtgatgacaggtgcctgtagtcccagctactcgggaggctgaggcaggagaatggcgtgaacccgggagacggagcttgcagtaagccgagatcgcaccactgcactccagcctgggcgacagagcaagtctcaaaaaaaaaaaaaaagtgatagaatcagagagtttttcctctaaccaaactgccaaagttggttttggctaagaatttcccaataatatttatgctgctgctcatttttttagttttctgagacaggggtctccctctgtcacccaggctggagtgcagtggtgacagatcactgcagcctccaactcctgggctcaagtgatcctcccacctcagcctcctaagtaactgggactacatatgtgcatcaccacgtccagttaatttttttttaagtagaggtgggggttttgctatgttgcctatctggtcgtgaactcctggcctcaagggatcctctggcatgccttggcctcccaaagggctaggatcacaggcaaaagccaccgtgtgtttatttttcccattcccttcctttatctgcaatgcttttttctttaaggcagcctaatttacaagcttggccttgaattaaaagagaacccagaacccgctcttggagtttacgttctcaaaccaacatcagagcaactgtctatccccatataaataaagttatctacccctgctcctaactgggtacaagttatgactacaactcagtgattttttaaattagtgtgcctatttggtgaaatctgtgaacttaatcaaggacaaccacacatgtcaattactaaacatttaaaatatatttctaaacagaatgggccgactcagtcacagtaactgttgatctccatagtagagcaacccacaaagacagaactgatttttttcccataatcaggggtgaaaaatatacaacttgtttctgaaccaaaaccacaatttctgcagtttaaaatgtttcactgctaatatggccctggtagaaattatgtagttttttttcttctttaaaaaaaaaaaattaaaaaaatttcctaagacactaaatcctcaatctggaatgtagattctgagcacaaagcagctcagttaacctaaaaaataaagaaaaaattcccatcacctgtctcagtagggcctgaaaggagagaagtagtgtggggaacccctgctttggtatggagagtcacggccccttgacccagaccgagaccgtgagtagccatagctggtgcttctctcaggataaactcggatgtaggaagtttcaccctgaaatgcaaacaaaaacaaaaagagtaaaggggaaaaaaatcagagccagaagaataagcaaaccaacatctaacaataatagttaagtattgagcacttactgtgtactctgtgcctggcatgaggctatctcattaaaccttcataacattatgaggtaggtactcttactatcccatttcaagaatgaagaaaattaagacttaagttatatcatttgcccaaggtaacacaataaatgccaatttgacatgttgatactcaattaactatgataaacaatatatctgaattactgccattgacccccctcaaagctaagaactggaaaggatctcaggggtcatatagtttaatcccctgccacctcatgtatgcatctttggatgggcatctatggaaggagctagcctgtatttaataccttccagatgtgaggacctgagctagatgctttagacgttatcctcttgctctagattcctggcaagtcttgtgatggtgctattatgtgaccattttgcccatgaaggaatcgaggtcccaagagtagttcaggtaaggaattaataagcagcagaggagtcatgtccaggctggcttgtccccaggccctctgccttcagccaccattctcagaagatccaaagatgccaaggggaaagaagccggatgctttttcaccttaggtgaaagtcagtaattggagttaccctttctgaggccctgctttgcagtataactgaggatcaggtgctgttctgtttctgcttcaaattcaagtcctagaggacagtctgaacaaaagcatcattaaaccagggaaggaccaacctctaagccaaaaactaggcaattatatgaatcctcagaaaaagaaatgagcccagagacctgtgtccccaaacatccgtaaatctcatagtaaggcaggacaggataaccagaaaaaaacaatgtccaactggtctggtttctggtctcaatggtaccaaagggatagtcaccacctcaatcaaactgagatccaaaacagcagctgctttcctacaaggaaagacatcaagaactactgagtctgaagggtgacataatcaaccacaagaaaatgttacggtttagcctggcacagtggtgcatgcctgcagtcccaactactggagaggctgaggtgggaggactgcttgggcccaggagttcaaggtcagcctcggcaatataatgagactgtctctaaaatcaaaaattagagaaatataaaaattataaaattaaaaaagaaaatgtcatgatagctcaggtttcagagaggatgctgcactactctgggaaaaaagtgaagtgacagctcagccctgacagcaggacctagaagggctgagatgaagaggctgacctgtagagctcagcctggacccacaggaggggtagttgagttcacagagggatactgccatttaagctggttgtgaatggggtggtatgaagaccgactgcactagtattctctccaggttacaaataccatgaccaaactgtgtaatgtgatactaatatgcagaataaagcatattaaaaaacaaa

SEQ ID NO: 137712 - DNA, 931 bp, Homo sapiens
  Payload ID: 6964
  Gene Symbol: GATC
  Gene Name: glutamyl-tRNA(Gln) amidotransferase, subunit C
  ENST ID: ENST00000548171
  CDS Start-End: 38-403
acgcgcgggcgcactgcgggggccaaggaaggaagaaatgtggtcgcggttggtgtggctgggccttcgggcccctctgggcgggcgccagggcttcacctccaaggcggatcctcagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacaggttggagtgcagtggtgtgatctccgctcactacaaactctgcttcctacattcaagtgattcttgtgcctcagcctcccaggtagctgggattacagatgtctatacctgagatccgacaatgtggtagaaggcaactgtgctgatgaattactacaaaactcccatcgcgtcgtggaggagtactttgtggcccccccaggtaatatctctttgccaaagctggatgaacaagagccattcccacacagctgagtagctcattctggaaagggggtactctgtgaacatgtggaagcataatgacagtatttttttactgtgaatactaatgttcctgcttttttcagtcccctgaaaaaatggatgctcaagcatttcttaataacagattcttctgaagacagaattgggaaagatctggccccaacaaggcagtgagttcctgatgctaactgaggtgaaagaaaagcaaaagtcagcttccaaggaattcacttaacaggcctgttcagtatggaagacattatttatctgcctttaactccccccaaaggaccataccaactgcatgaaagtgaacttttctatctacgtaactggtagacggagcatcttgatcactatgtgacaaccttgg

SEQ ID NO: 137713 - DNA, 1211 bp, Homo sapiens
  Payload ID: 6965
  Gene Symbol: GLRX
  Gene Name: glutaredoxin (thioltransferase)
  Uniprot ID: P35754
  ENST ID: ENST00000237858
  CDS Start-End: 344-664
gtaagcactttatgcttccccagaggtgactaaactctgatcattgccaatgggcaggcactccccaaatgtccaaggacaacaaagatacccagagtgtctttcatagctaccaatgattaaatagcaagtattgcattcctgggcattgctaactagtgaagtataccagatggaaatgtcttcgaagctgtccctttaaaactcgagcaagctaccaggcaaactccgcctccagggaggttccttattaaataggagccaactggctgggtcggggctcaataccccaagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagatctcataggaaatgttcaacaattctgtgaaaggtcacaggacccaattggagaaatcatatgaaaagcatagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaataaaaaaaacctatagatgattcagtgatttttgtccaattcatttgcatgttctcaagacattaaggaatgttatgcgaaatacactaacttaaaactgtgtttatatttggccctgccattataaataaagacacgtgctgctgtca

SEQ ID NO: 137714 - DNA, 1366 bp, Homo sapiens
  Payload ID: 6965
  Gene Symbol: GLRX
  Gene Name: glutaredoxin (thioltransferase)
  Uniprot ID: P35754
  ENST ID: ENST00000379979
  CDS Start-End: 53-373
aagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagaacaggccccatgctgacgtccctcctcaagagctggatggcattgcaaatgatgacagcacttctggtggatgaatttgggggcacaaacagcttttttcctcttttggctcagtatttaaaagtggaccaacttgctcttaatcacagggccaagaaggttgacgggccatcttggttttcttctggatgtgctctttggttttcagaagactgtgacaagttctggcccaggattcgctcactgaccctcaattgtcctctttggcatgcgtttcttactgttctccatgtgtcggcatgtctctacctctaagccagtgtttttcaactatgtttatccagactccttctccacaatgatgaatccacagttggttatctgctactgcccattagctaaaatcattttgctgcttgactttatggagtttgtattatgaaatcagtgggtattttgaatgtgttctttctaactacatgcatctctccactcaactccaccccatcccatcccaccttgaaaatcactgctctgaaccagtgttctccaccttgtcctccacagatctcataggaaatgttcaacaattctgtgaaaggtcacaggacccaattggagaaatcatatgaaaagcatagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaataaaaaaaacctatagatgattcagtg

SEQ ID NO: 137715 - DNA, 533 bp, Homo sapiens
  Payload ID: 6965
  Gene Symbol: GLRX
  Gene Name: glutaredoxin (thioltransferase)
  Uniprot ID: P35754
  ENST ID: ENST00000508780
  CDS Start-End: 65-385
gctcaataccccaagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagaaatggagtatcactatgttgctcaagctagactcaaactcctggactcaagggatcctcccgcctcagccttccaagtcactgggattataagtgcatgccatcccacgcagctactctcttgaatactcgagaaagccaa

SEQ ID NO: 137716 - DNA, 473 bp, Homo sapiens
  Payload ID: 6965
  Gene Symbol: GLRX
  Gene Name: glutaredoxin (thioltransferase)
  Uniprot ID: P35754
  ENST ID: ENST00000512469
  CDS Start-End: 50-370
caatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacaggtgagtggcaggtgaggtgctgggccaggaacatgggagaccgtggaattcttctgtcgtggtttgttatactgtatgacagcattctggttggggg

SEQ ID NO: 137717 - DNA, 632 bp, Homo sapiens
  Payload ID: 6965
  Gene Symbol: GLRX
  Gene Name: glutaredoxin (thioltransferase)
  Uniprot ID: P35754
  ENST ID: ENST00000505427
  CDS Start-End: 61-381
aataccccaagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagggccaagaaggttgacgggccatcttggttttcttctggatgtgctctttggttttcagaagactgtgacaagttctggcccaggattcgctcactgaccctcaattgtcctctttggcatgcgtttcttactgttctccatgtgtcggcatgtctctacctctaagccagtgtttttcaactatgtttatccagactccttctccacaatgatgaatccacagttggttatctgctactgccca

SEQ ID NO: 137718 - DNA, 701 bp, Homo sapiens
  Payload ID: 6966
  Gene Symbol: GLRX2
  Gene Name: glutaredoxin 2
  Uniprot ID: Q9NS18
  ENST ID: ENST00000367439
  CDS Start-End: 50-544
gatccgcggtgtccggcagtagagctcgctgcagatccgggctctgaccatgatttggcgccgcgcggcgctggcggggacgcggctggtttggagcaggagcggctcggcaggctggcttgacagggcggcgggagctgcgggagctgcggcagctgcggcctctgggatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtgatgtttatactaataagtttgctagtacagtgtcagttatttaaagtggtaatgcccgataatgtcttttaaatgtttgaggatgttttaaatacatgcattgtcttcacgaagaagatgtaaaaataatgaacaataaattgcggtggaaacctctt

SEQ ID NO: 137719 - DNA, 1131 bp, Homo sapiens
  Payload ID: 6966
  Gene Symbol: GLRX2
  Gene Name: glutaredoxin 2
  Uniprot ID: Q9NS18
  ENST ID: ENST00000367440
  CDS Start-End: 477-974
aaggctattattaccaccactgagtggcttaaataatcctgtcaacagcaatcgcccatttccaaagccatggtgaaacatctctgtgctaatttcttttgttttgtttcctaattttttttttttggcaggtggtgggaaataatctttgtcttctttggagtaaaccttcaacaccggattttttcttttaattatggatgtaaaccccaatatccccataatttacattgggtctcgaccaattgcctaattataagaggatatatttaggctcttatttcatccacacaaaaacttgtgtaacaggtagttggaaacatctgaggcaccactttgattctgttttggatggtcatgttttttctcctccgtttccccagcatgtctgccaccatcctcatgcactgcttccaagtgcctgggagcctttatgagcgtccctaaacctaaaagaatccagaggcggggctcggatgaaccctcgagataagcaagtgagccgcttctcccctctaaaggatgtttacacgtgggtggcactcgctggaatccagcgctcgggcagccctgggaggacgcgctcagctgcgaggaggatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtgatgtttatactaataagtttgctagtacagtgtcagttatttaaagtggtaatgcccgataatgtcttttaaatgtttgaggatgttttaaatacatgcattgtcttcacgaagaagatgtaaaaataatgaacaataaattgcggtggaaacctctt

SEQ ID NO: 137720 - DNA, 1302 bp, Homo sapiens
  Payload ID: 6967
  Gene Symbol: GLRX3
  Gene Name: glutaredoxin 3
  Uniprot ID: O76003
  ENST ID: ENST00000331244
  CDS Start-End: 23-1030
gcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattgtaagaaatatttaattacattgggagcagttcatgatttagtcctcagaaatggactaggaatagaaaattcctgctttctcagttacatgttttgtgtatttcacaatgtcgtgctaaataaatgtatgttacatttttttcccaccaaaaatagaatgcaataaacatcttcaaattattaacaataattgtatgaaaaaagtgtatctttacagcagtattaaacatacagctactataa

SEQ ID NO: 137721 - DNA, 3827 bp, Homo sapiens
  Payload ID: 6967
  Gene Symbol: GLRX3
  Gene Name: glutaredoxin 3
  Uniprot ID: O76003
  ENST ID: ENST00000368644
  CDS Start-End: 23-1030
gcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattacggggtctggctctgtcacccaggctggagtgcagtggcacgattatggctcattgcagcctcgacttctcggggccaagcgatcctcctgcctcagccttctgagtagctgggaccacaggcgtgcaccaccatgcccacctaattttttatttcttgtagagatgaggtctcctgcctcagcctcccaaagtgctggaatttacaggtaggaccaccacacttggtccacttacttataataaacattgatttggtcgttcaggttcctttggtcctcctattgagaacagtttgaagtccatgaaaattttaacaatatttttgatcctgaatctaacatatttgaaaaatagttgctccactaggcttccacagtgcaggcttcaaatgggatggctaaattcacctcatggttcttagttttttttgtacttgtggcacattctcttcatatattaccccaccctgtttgtttgggcagttaagatgctggtactgtctggtggcgataaggaaagggaaacagaagtcagtaattcagacaagaataaacaggatgaaatgcatctattcctaggtaagattagcccaccacctccacactgctgctgtctcttcagctcaggctgtttttctctgttttgattgtgtaaagagtagagtgctgatttgtgtgttacagagggtggtctgtacaagtcataaagctcgacatggccttgcttcctgctaggtgttaggacacccatgatggtggagtctcttggcattctgtgtaattagataaggctgtttatagcattggtccatgagaacttccttgtttctatttaaaatgaaaatcattgtataagtaaaacttcttaaatgtagatagaaatagaatttttactgaaattttatgaagccattggccgcagggatgtgtgtcatggaggagggctccatacttttttggtatacttatctcaaacttaattcatttgcatactgctttttctctaagtgccaactgtcctagtatattttctaagtcaacttttactttcactttatcctaagcaagaatatctttggcatcacagactcagtaagcctgtttttttctaatgcacatacaaataaataaaatgcacaacttttaacataaatggctgcctccaatttgggaaatactgttctggccagaggccgttgctctgataatgtcatgtggttagtgcattttaggaagacctcctttccctttggttgactcctgcaggacataagatatcagtgacgttatcctttgttgagccatcctggtttgagtcaggatgagtgttgagagtttttggggagttgcccctgtgtcctatattattttatcctcttaaagtctgatggtctttggctccactgactccaggtaagttggggtgacagtgcagcatatttctattttctagttgtttctggccagacatggggaaggtcaagacatcttgttcatgcaaacggattgatggccattcctaatctgattttattagtgtattttaggaagtaaagtaagattcttgagcccagctgaacttcccctattgaattttctaacaaaaagagagtttgcgtatgggtttataattgagcctgctcttgtagaaatgttttatcagaattgaaatcctctctgatccccaaattctagagacaaagttgttttctgaatttgagaaatctgttcagttcacaaggaaaggtgacaatgtgtcatttggatgttgtcccacacgtgaggcctcgttgggtgcttgtggtgggagggaccctccaggcaggctttgtatggagggttttcatgtctggacacatttctgttccgagaagcactgctgcgtttttgggagcgtggaccctggccagagcctgtggccagctctgcctgccctccctttcttggcctgctcttttgagtatgtagtggggctttgtgtggcatcctgccaggttaaagctgcatggtgcttaggatagagctggtgctgtggggaggctcttgatgatgggggctgccatctatttgcctgttaactcttagaaaccaaacctcaaatgtcagaatttcctttctagaagaggctggttgaataggaaccagaaaggccctcatacaggcagggctgttcactcctcttgacttgcgtgtttgtgccttccttgtaggaaggcttcttagggaattgttatctgtttaggggaaataagcctgcaggaatgaacttttttttaaaataaaaactcttgatcaaaaatggaaagaaaaaaaccagtgaaacaggctaggtagtttgtggaattctcctttgcaggtgaggggagaaagcagctatctcaagggcacagctacagattgggagctggggcttccatccagggtctgggacacccaaaccttaggcttgcccctcccgggaggcctccccctcagagctatgtgggatgcagttgcctttttacctgtgatgagaaactggtgaattgccaggattctggctctggcttcagtctgcccctttccggggattagagggcattaaccctacttcctacagccaagcagctcttcctcatgactctactttctaactccgggggttgactgattgatttgaagaccgccttgttgatgaatgtgttgaaacttgctatcataatgtaaatgctccttaataaaataacaggacctggtgggttcagttgccttgcccacgtgtgactta

SEQ ID NO: 137722 - DNA, 1921 bp, Homo sapiens
  Payload ID: 6967
  Gene Symbol: GLRX3
  Gene Name: glutaredoxin 3
  Uniprot ID: O76003
  ENST ID: ENST00000481034
  CDS Start-End: 23-1030
gcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattacggggtctggctctgtcacccaggctggagtgcagtggcacgattatggctcattgcagcctcgacttctcggggccaagcgatcctcctgcctcagccttctgagtagctgggaccacaggcgtgcaccaccatgcccacctaattttttatttcttgtagagatgaggtctcctgcctcagcctcccaaagtgctggaatttacaggagtgtcggctgtgccccttgtgatgggtgaggaaaggtatccacctttctgaatcagacacaagctgcagtagcttcctgatgcctcattcaccaggatgggtaactttaaagacaagttttataactggcatcccatctggtttcagagtcttgggggcttttttcatacagctttgtctgatatttagagacattcagattcagaagccatgagttcagttagctcatgggccgggcacgtgcactgactcactggctgcagcagaacacgttgagggagtcttggtgcacttaggtcactgtaaggttctagggctgggagctgggatttgaaccaggatctgtcagcgcagccccagtgctgtgcttgaagcctcgtgccacactggctttgaggtagcacgctgcaagttagtgagtggagttgcccaagtctggggcttctgaaatgacctggtatttttatgttcctgttagaaatggtgtggctttcacaaattaagtgccaggctgggcacaatggctcgtgcttgtaatcccagcactttgggaggcggaggcaggcgggttgcttgagctccggagcttgagaccagcctgagcaacatggcgaaacctcatatctacaaaaaataaaaaattaactggtca

SEQ ID NO: 137723 - DNA, 1564 bp, Homo sapiens
  Payload ID: 6968
  Gene Symbol: GLRX5
  Gene Name: glutaredoxin 5
  Uniprot ID: Q86SX6
  ENST ID: ENST00000331334
  CDS Start-End: 498-971
cgcattgccatggcaattcaaccgccgctgacaccggaaccggaaacttcatcaggaggtgaccccttcccggcgttccgcggaacgggcgagtcccgcgcctctcccagttgtctcggcgtagtccagctggcctcattggctcacaggaggaaagtcgtcttccctcttgttttgcctctcgttgccctgcaagcgtgaccctgatggacatccagtctctccaattaactaacaaagcggttgccgacgaccaatagtaaggcagtaggatgaggctccggcataaggcccacctcctacctgccgggcgggacgagcaacatgattggtggaatcgagtaattactgatcagtattgtccaatcacggagggcagtttagagccggcccaatgagggcctccagggggcgggtcggactgccgcgggccggggagcgctctgggtggccagctgtgggcccgggccgtcgtgggctccggcttgcgtgcggagatgagcgggtccctcggccgagctgcggcggctctgctccgctgggggcgcggcgcgggcggcggtggcctttggggtccgggcgtgcgggcggcgggctcgggcgcgggcggcggcggctcggcggagcagttggacgcgctggtgaagaaggacaaggtggtggtcttcctcaaggggacgccggagcagccccagtgcggcttcagcaacgccgtggtgcagatcctgcggctgcacggcgtccgcgattacgcggcctacaacgtgctggacgacccggagctccgacaaggcattaaagactattccaactggcccaccatcccgcaagtgtacctcaatggcgagtttgtagggggctgtgacattcttctgcagatgcaccagaatggggacttggtggaagaactgaaaaagctggggatccactccgcccttttagatgaaaagaaagaccaagactccaagtgagggcggccaagtcctcgctgagcagagagggagccgttcatgtcagagactcactgccagaaaagccttacccattttggttttcactattgagaccgcaactgcttgcactgatcattttggttcgtgagcagttggtgattttagttggtctggtgttcgggctaagaatattttattgtggacttaattacaaccactgcactgtaatgattcaatgctgtattatgatattgctgtaaacaaaattcattcttatattgtcacttattctttgcctgattcagaagttaaataggagctttggaatcattattcatgacccctctgcaaatgtgtcagtctccaaagagagtatctccccccaaattttgtgtagcttcttttgttatggaaaatggtgaacaaaaaaagaaactgtgataactggggcgttgttttttaaaataaactccagcacagggatgctgtgcatgcctgagttgattccgaagtgcatatgtctgtaaggatttggagtgcctgcagtgttttatgtgtgggaagtaagggtgagtctcatattcttctattaaatttgccacaagaattgc

SEQ ID NO: 137724 - DNA, 1863 bp, Homo sapiens
  Payload ID: 6968
  Gene Symbol: GLRX5
  Gene Name: glutaredoxin 5
  ENST ID: ENST00000557731
  CDS Start-End: 1-412
cggagcagccccagtgcggcttcagcaacgccgtggtgcagatcctgcggctgcacggcgtccgcgattacgcggcctacaacgtgctggacgacccggagctccgacaagtcatcatccttgtggctcagaattgaacagagtagttgcacagctgcgctgtcacagagtgtccctcatctcatgtgtgtcctcagagccatttgcacacaggactgatcacatgcatgctggttggtttcttggctgctgtgagcgcttaagagcagagcgggtctcactcccccacccctcagccctggacagggaccttgctgagctctgggccttcattagactcaccagtcacttcgggttctgcacagagcctcatcatccactccacagagagcccatcacagtggctggatagatgggaactgacaacccatagctgtgggacagggatttttccctgggtaaaagtaattgttaaaaattaaaaaaaaaaaaaactcaacaactcatcatctcgaggagaagtgactgacggcctgcaccaacttagacagtcacagtcatgaaaagtgcacaggtgggattgcccgagttggccatgaattaccgtgatggatccatttggaaatgaagttggttgtgacatttcttcaagttttgtttcgcttgaagcttgactggtagatggagaattttggccttatgtatcttatgtgacttgcattacccagtccagtcctctgccattaatctaaggtccgcaatgtatcaggtattttactgagaatcttgcttacctaattctcacaaaaaaaaaaaccttgggagatgagggtggaaacaggatgagaggtcaggtgacttgtctgagggctgacggtttgtaattggaagagtcagggcctaaccactggtctctttgacacaaaaactcatgctcttagtggcaagcacagtgttctcaagattgggggaagccagggagggacagtgggttgtctgctactagtgggtcaaaattacatatttagtcatgaatggttcagcttttaccatttaaataacaaataaatgttctttctccataggcattaaagactattccaactggcccaccatcccgcaagtgtacctcaatggcgagtttgtagggggctgtgacattcttctgcagatgcaccagaatggggacttggtggaagaactgaaaaagctggggatccactccgcccttttagatgaaaagaaagaccaagactccaagtgagggcggccaagtcctcgctgagcagagagggagccgttcatgtcagagactcactgccagaaaagccttacccattttggttttcactattgagaccgcaactgcttgcactgatcattttggttcgtgagcagttggtgattttagttggtctggtgttcgggctaagaatattttattgtggacttaattacaaccactgcactgtaatgattcaatgctgtattatgatattgctgtaaacaaaattcattcttatattgtcacttattctttgcctgattcagaagttaaataggagctttggaatcattattcatgacccctctgcaaatgtgtcagtctccaaagagagtatctccccccaaattttgtgtagcttcttttgttatggaaaatggtgaacaaaaaaagaaactgtgataactggggcgttgttttttaaaataaactccagcacagggatgctgtgcatgcctgagttgattccgaagtgcatatgtctgtaaggatttggagtgcctgcagtgttttatgtgtgggaagtaagggtgagtctcatattcttctattaaatttgccacaagaattgccgtcga

SEQ ID NO: 137725 - DNA, 991 bp, Homo sapiens
  Payload ID: 6969
  Gene Symbol: GRXCR1
  Gene Name: glutaredoxin, cysteine rich 1
  Uniprot ID: A8MXD5
  ENST ID: ENST00000399770
  CDS Start-End: 1-873
atgcttaaaagggagatgaagccagaaagtgacaggccacggaaagtccggtttcggatcgcgtcctctcacagtgggcgagttctgaaggaagtgtatgaagatgggcaaccgtcaggctctctggattctgaatgtgccagtatctgtgggatagatggactaggtgattccgatggacagcagaatggccacatagagtcagaaggtgatgagaatgagaatgaccaggatagcttgctggtgttagcaagggctgccagtgagaagggttttggtacaagaagagtcaacattttaagcaaaaatggcacagtcagaggcgtcaaatacaaagtgagtgctggccaggctctatttaacaatttgaccaaagtattacagcaaccatcaactgatctagaatttgaccgtgtagtgatttataccacctgccttcgtgtggtccggacaacctttgaaagatgtgaactggttagaaagattttccaaaaccatcgcgtaaaatttgaagagaaaaacatagccctgaatggtgaatatggaaaagagttagacgaacgatgccgacgagtttctgaagctccttccctccctgttgtgttcattgatggccattaccttgggggtgctgagaaaattttgtcaatgaatgaatcaggagaactgcaagacatcctaaccaaaattgagagagtacagcatccacatgagtgtccctcttgtggaggctttggctttcttccatgctccgtgtgccatgggagcaagatgtccatgtttcgaaactgcttcacagactctttcaaagccctgaagtgtacggcttgcaatgaaaatggtcttcagcgttgtaagaactgtgctggttaattggagcttctacccaggaaaaacctcattttattaatcaaaggcaatactttggtttatatatatatttttaaatggttatgtttatggattaatcaataaactttgtttattataa

SEQ ID NO: 137726 - DNA, 747 bp, Homo sapiens
  Payload ID: 6970
  Gene Symbol: GRXCR2
  Gene Name: glutaredoxin, cysteine rich 2
  Uniprot ID: A6NFK2
  ENST ID: ENST00000377976
  CDS Start-End: 1-747
atggaggaccctgagaaaaagctgaatcagaagagtgatggcaaaccccggaaagtacgatttaaaatctcctcctcctacagcggtcgagtattgaagcaggtctttgaggatgggcaggaattagagtcaccaaaggaggaataccctcacagttttctgcaagagtctcttgaaacaatggatggtgtttatgggtctggggaagtccccaggccccagatgtgctcccctaagctgactgctcagaggatcagtgtgtttagagagggtaatgcctacaccttggcaggcggccagcctcggttcaacgattacaaggcgaatgaccataagcccctacctattatagattttggaaagataatcatctacactaataacctgaaaatcattcgaaccccaatggacaagagagattttgtgaggaaaattctccagaaggaagaggaggctgaggaagagtctctgatgaacaaagaagaaagctatggaggcagggaccagcacgatagacctttggtggaggcagaaagcacattaccccaaaaccggtatacacaggaaggggatattcccgaggacagctgttttcactgccgagggtcgggcagtgccacctgctctctgtgccacggcagcaagttctcgatgctggccaacagatttaaggagtcctatcgggccctgaggtgccctgcctgcaatgagaatggcctacagccttgccagatttgcaatcaatag

SEQ ID NO: 137727 - DNA, 1956 bp, Homo sapiens
  Payload ID: 6971
  Gene Symbol: GCDH
  Gene Name: glutaryl-CoA dehydrogenase
  Uniprot ID: Q92947
  ENST ID: ENST00000222214
  CDS Start-End: 212-1528
ttccacaggcaaggctaccttagcccttttaaaaggcagagctgcggagggggccggattctaggaggaaccaatgaaaagcctcactcggcctccgctcctcccacttcttgctgaggtcaaaggcctgcgtcagttgcactgtagcctcggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagtttttcatcgggagatcatttcggagatgggggagttgggtgtgctgggccccaccatcaaaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaagggggagctcctgggctgcttcgggctcacagagcccaacagcggaagtgaccccagcagcatggagaccagagcccactacaactcatccaacaagagctacaccctcaatgggaccaagacctggatcacgaactcgcctatggccgatctgtttgtagtgtgggctcggtgtgaagatggctgcattcggggcttcctgctggagaaggggatgcggggtctctcggcccccaggatccagggcaagttctcgctgcgggcctcagccacaggcatgatcatcatggacggtgtggaggtgccagaggagaatgtgctccctggtgcatccagcctggggggtcccttcggctgcctgaacaacgcccggtacggcatcgcgtggggcgtgcttggagcttcggagttctgcttgcacacagcccggcagtacgccctcgacaggatgcagtttggtgtcccactggccaggaaccagctgattcagaagaagctggcagacatgctcactgagattaccctgggccttcacgcctgcctgcagctcggccgcttgaaggaccaggacaaggctgcccccgagatggtttctctgctgaagaggaataactgtgggaaagccctggacatcgcccgccaggcccgagacatgctgggggggaatgggatttctgacgagtatcacgtgatccggcacgccatgaacctggaggccgtgaacacctacgaaggtacacatgacattcacgccctgatccttgggagagctatcacgggaatccaggcgttcacggccagcaagtgagccgctccatcaggggcccgaaactctcaagcccctttctggagagatgcctggctggaccgtaggagcgctgtgctctgagcttagaaagggaggtggcggatggagtgggaagtgagagacactgatttttaaatatcaaaatttcccttctgaagtcgttcagatgtgttccttaaaaagaagatggaattctctgtagagcgtctcaatccacttttaaccatggatgagagcagactccatttaccctgaaatagcagcttctcttgagaggagagtgacatggaagcaactccgtctgctgcagctgaccccctcacactgagttcacagtgcgccctccctccctcccatctgggggtagtgccttatgctgggtgttggagcagagtgagggagaggaaaataaagacctgcacatctga

SEQ ID NO: 137728 - DNA, 523 bp, Homo sapiens
  Payload ID: 6971
  Gene Symbol: GCDH
  Gene Name: glutaryl-CoA dehydrogenase
  ENST ID: ENST00000589039
  CDS Start-End: 78-523
agttgcactgtagcctcggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaa

SEQ ID NO: 137729 - DNA, 562 bp, Homo sapiens
  Payload ID: 6971
  Gene Symbol: GCDH
  Gene Name: glutaryl-CoA dehydrogenase
  ENST ID: ENST00000588905
  CDS Start-End: 70-562
tgtagcctcggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagtttttcatcgggagatcatttcggagatgggggagttgggtgtgctgggccccaccatcaaaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaagggggagctcctgggctgct

SEQ ID NO: 137730 - DNA, 1867 bp, Homo sapiens
  Payload ID: 6971
  Gene Symbol: GCDH
  Gene Name: glutaryl-CoA dehydrogenase
  Uniprot ID: Q92947
  ENST ID: ENST00000591470
  CDS Start-End: 146-1462
agttgcactgtagcctcggcagtgaaccgggaggtactaccaggtaaggaaggtgcggtagccccagccgtgggtgagaggagctccgctctgacacccccgctcctgtaggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagtttttcatcgggagatcatttcggagatgggggagttgggtgtgctgggccccaccatcaaaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaagggggagctcctgggctgcttcgggctcacagagcccaacagcggaagtgaccccagcagcatggagaccagagcccactacaactcatccaacaagagctacaccctcaatgggaccaagacctggatcacgaactcgcctatggccgatctgtttgtagtgtgggctcggtgtgaagatggctgcattcggggcttcctgctggagaaggggatgcggggtctctcggcccccaggatccagggcaagttctcgctgcgggcctcagccacaggcatgatcatcatggacggtgtggaggtgccagaggagaatgtgctccctggtgcatccagcctggggggtcccttcggctgcctgaacaacgcccggtacggcatcgcgtggggcgtgcttggagcttcggagttctgcttgcacacagcccggcagtacgccctcgacaggatgcagtttggtgtcccactggccaggaaccagctgattcagaagaagctggcagacatgctcactgagattaccctgggccttcacgcctgcctgcagctcggccgcttgaaggaccaggacaaggctgcccccgagatggtttctctgctgaagaggaataactgtgggaaagccctggacatcgcccgccaggcccgagacatgctgggggggaatgggatttctgacgagtatcacgtgatccggcacgccatgaacctggaggccgtgaacacctacgaaggtacacatgacattcacgccctgatccttgggagagctatcacgggaatccaggcgttcacggccagcaagtgagccgctccatcaggggcccgaaactctcaagcccctttctggagagatgcctggctggaccgtaggagcgctgtgctctgagcttagaaagggaggtggcggatggagtgggaagtgagagacactgatttttaaatatcaaaatttcccttctgaagtcgttcagatgtgttccttaaaaagaagatggaattctctgtagagcgtctcaatccacttttaaccatggatgagagcagactccatttaccctgaaatagcagcttctcttgagaggagagtgacatggaagcaactccgtctgctgcagctgaccccctcacactgagttcacagtgcgccctccctccctcccatctgggggtagtgccttatgctgggtgttggagcagagtgagggagagg

SEQ ID NO: 137731 - DNA, 423 bp, Homo sapiens
  Payload ID: 6971
  Gene Symbol: GCDH
  Gene Name: glutaryl-CoA dehydrogenase
  ENST ID: ENST00000591050
  CDS Start-End: 1-308
tgggccttcacgcctgcctgcagctcggccgcttgaaggaccaggacaaggctgcccccgagatggtttctctgctgaagaggaataactgtgggaaagccctggacatcgcccgccaggcccgagacatgctgggggggaatgggatttctgacgagtatcacgtgatccggcacgccatgaacctggaggccgtgaacacctacgaaggtgagctcattcattccacagctgctgctgaaacaatgactcccacagaaccatctccagaccctcaccccaccccgagttccgggtcagaaagttgaactgtatcctggacatgtggatgtccctggccaccgaaagtggctcagataaacaaggacaacacagaactcatgttcttgtctctgccagagaagccaccacctaccggaaacc

SEQ ID NO: 137732 - DNA, 496 bp, Homo sapiens
  Payload ID: 6971
  Gene Symbol: GCDH
  Gene Name: glutaryl-CoA dehydrogenase
  ENST ID: ENST00000590445
  CDS Start-End: 74-334
gcactgtagcctcggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtgtaaggacctctggtcgcaccgtgtgtctgctgcccctgttcagctgtctgtctgccgcaggtggactctgtcccagaatccgagagctgcccgagcggggtggcagggtcgtggccagggtcagaggcactaaggcacctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagtttttcatcgggag

SEQ ID NO: 137733 - DNA, 1871 bp, Homo sapiens
  Payload ID: 6971
  Gene Symbol: GCDH
  Gene Name: glutaryl-CoA dehydrogenase
  ENST ID: ENST00000590530
  CDS Start-End: 72-686
actgtagcctcggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagagtctggctctgttgcccaggctggagtgcagtggcacgatcttggctcactgcaaattctgcctcccaggctcaagcgattctcctgcctccacccctctagtagctgggattacaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctggccaagggggagctcctgggctgcttcgggctcacagagcccaacagcggaagtgaccccagcagcatggagaccagagcccactacaactcatccaacaagagctacaccctcaatgggaccaagacctggatcacgaactcgcctatggccgatctgtttgtagtgtgggctcggtgtgaagatggctgcattcggggcttcctgctggagaaggggatgcggggtctctcggcccccaggatccagggcaagttctcgctgcgggcctcagccacaggcatgatcatcatggacggtgtggaggtgccagaggagaatgtgctccctggtgcatccagcctggggggtcccttcggctgcctgaacaacgcccggtacggcatcgcgtggggcgtgcttggagcttcggagttctgcttgcacacagcccggcagtacgccctcgacaggatgcagtttggtgtcccactggccaggaaccagctgattcagaagaagctggcagacatgctcactgagattaccctgggccttcacgcctgcctgcagctcggccgcttgaaggaccaggacaaggctgcccccgagatggtttctctgctgaagaggaataactgtgggaaagccctggacatcgcccgccaggcccgagacatgctgggggggaatgggatttctgacgagtatcacgtgatccggcacgccatgaacctggaggccgtgaacacctacgaaggtacacatgacattcacgccctgatccttgggagagctatcacgggaatccaggcgttcacggccagcaagtgagccgctccatcaggggcccgaaactctcaagcccctttctggagagatgcctggctggaccgtaggagcgctgtgctctgagcttagaaagggaggtggcggatggagtgggaagtgagagacactgatttttaaatatcaaaatttcccttctgaagtcgttcagatgtgttccttaaaaagaagatggaattctctgtagagcgtctcaatccacttttaaccatggatgagagcagactccatttaccctgaaatagcagcttctcttgagaggagagtgacatggaagcaactccgtctgctgcagctgaccccctcacactgagttcacagtgcgccctccctccctcccatctgggggtagtgccttatgctgggtgttggagcagagtgagggagaggaaaataaagacctgcacatctga

SEQ ID NO: 137734 - DNA, 453 bp, Homo sapiens
  Payload ID: 6971
  Gene Symbol: GCDH
  Gene Name: glutaryl-CoA dehydrogenase
  ENST ID: ENST00000587072
  CDS Start-End: 61-453
ggcagtgaaccgggaggtactaccaggtcgccgtcgttgctccgctcgctctgagagagcatggccctgagaggcgtctccgtgcggctgctgagccgcggacccggcctgcacgtccttcgcacgtgggtctcgtcggcggcgcagaccgagaaaggcgggagaacacagagccaactggctaagtcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaagtttttcatcgggagatcatttcggagatgggggagttgggtgtgctgggccccaccatcaaaggctcaagcgattctcctgcctccacccctctagtagctgggattacaggatatggctgt

SEQ ID NO: 137735 - DNA, 545 bp, Homo sapiens
  Payload ID: 6971
  Gene Symbol: GCDH
  Gene Name: glutaryl-CoA dehydrogenase
  ENST ID: ENST00000590472
  CDS Start-End: 1-346
gatgcagtttggtgtcccactggccaggaaccagctgattcagaagaagctggcagacatgctcactgagattaccctgggccttcacgcctgcctgcagctcggccgcttgaaggaccaggacaaggctgcccccgagatggtttctctgctgaagaggaataactgtgggaaagccctggacatcgcccgccaggcccgagacatgctgggggggaatgggatttctgacgagtatcacgtgatccggcacgccatgaacctggaggccgtgaacacctacgaagggatgttcctgagacaggtaagctccgaaggcagcccaggggtgaggcccgactcctagcaggctggtggacgcaagggagtgagcgaagctacacgcaggaatcaacgctccattttgttaagagacaaaagtcatcttcagatgacggtgtttgcaccctgtaactgatggtgatttacatgggggtccagaaccccttgcttggtgggaagacagatgtggaaaaagatacttaaaaaaaaaaaaaaagtgcaaa

SEQ ID NO: 137736 - DNA, 1106 bp, Homo sapiens
  Payload ID: 6972
  Gene Symbol: GPX1
  Gene Name: glutathione peroxidase 1
  Uniprot ID: P07203
  ENST ID: ENST00000419349
  CDS Start-End: 6-302
gcgccatgtgtgctgctcggctagcggcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggtgcgccgggcggagcggggcggggcgggggcggacgtgcagtagtggctgggggcgccggcggtgtgctggtgggtgccgtcggctccatgcgcggagagtctggctactctctcgtttcctttctgttgctcgtagctgctgaaattcctctccgcccttgggattgcgcatggagggcaaaatcccggtgactcatagaaaatctcccttgtttgtggttagaacgtttctctcctcctcttgaccccgggttctagctgcccttctctcctgtaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcag

SEQ ID NO: 137737 - DNA, 1146 bp, Homo sapiens
  Payload ID: 6972
  Gene Symbol: GPX1
  Gene Name: glutathione peroxidase 1
  Uniprot ID: P07203
  ENST ID: ENST00000419783
  CDS Start-End: 323-934
gagccctcgagggccccagcccttggaagggtaacctggaccgctgccgcctggttgcctgggccagaccagacatgcctgctgctccttccggcttaggaggagcacgcgtcccgctcgggcgcactctccagccttttcctggctgaggaggggccgagccctccgggtagggcgggggccggatgaggcgggaccctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 137738 - DNA, 897 bp, Homo sapiens
  Payload ID: 6972
  Gene Symbol: GPX1
  Gene Name: glutathione peroxidase 1
  ENST ID: ENST00000620890
  CDS Start-End: 81-689
cagttaaaaggaggcgcctgctggcctccccttacagtgcttgttcggggcgctccgctggcttcttggacaattgcgccatgtgtgctgctcggctagcggcggcggcggcggcggcccagtcggtgtatgccttctcggcgcgcccgctggccggcggggagcctgtgagcctgggctccctgcggggcaaggtactacttatcgagaatgtggcgtccctcggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagc

SEQ ID NO: 137739 - DNA, 990 bp, Homo sapiens
  Payload ID: 6973
  Gene Symbol: GPX2
  Gene Name: glutathione peroxidase 2
  Uniprot ID: P18283
  ENST ID: ENST00000389614
  CDS Start-End: 88-660
cttcctggctcctccttcctccccacccctctaataggctcataagtgggctcaggcctctctgcggggctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggaaa

SEQ ID NO: 137740 - DNA, 1134 bp, Homo sapiens
  Payload ID: 6973
  Gene Symbol: GPX2
  Gene Name: glutathione peroxidase 2
  ENST ID: ENST00000553522
  CDS Start-End: 20-256
gctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcagaactgctcagggtagactggagacaaaagcaacagctcagaagtgctaaatcttgaagagcagccaaagcatgggcaacaaagtgagaccccatctctacaaaaaaaaaaaaaaattagccgggcatggtggcctgtgtctgtagtctcagctactaaagaggctgaagcaggaggaatgcttgagcccagaagttcaaggctgcagagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggaaacggcca

SEQ ID NO: 137741 - DNA, 476 bp, Homo sapiens
  Payload ID: 6973
  Gene Symbol: GPX2
  Gene Name: glutathione peroxidase 2
  ENST ID: ENST00000557049
  CDS Start-End: 1-405
ttcattgccaagtccttctatgacctcagtgccatcagcctggatggggagaaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgcctt

SEQ ID NO: 137742 - DNA, 778 bp, Homo sapiens
  Payload ID: 6973
  Gene Symbol: GPX2
  Gene Name: glutathione peroxidase 2
  ENST ID: ENST00000557323
  CDS Start-End: 21-257
ggctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcaggagagacagaagtagcaaaccctctttcgagatgtccctccagccccagaagtacctccagcctcacaccatctcttcagcctagcaagttgctggagggagtctataacctaccaggagccagccagccatttgtatcaagaaatagaaatctgccagggtacagtggctcacacctataatcccagcgctttgggaggctaaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcc

SEQ ID NO: 137743 - DNA, 1084 bp, Homo sapiens
  Payload ID: 6973
  Gene Symbol: GPX2
  Gene Name: glutathione peroxidase 2
  ENST ID: ENST00000612794
  CDS Start-End: 180-749
cttgttcaaacagcacttacaggtggggacctgtttttgctaagtcatcctggggatgctcaaagctccattgttagatcctttctgtcctccttcctggctcctccttcctccccacccctctaataggctcataagtgggctcaggcctctctgcggggctcactctgcgcttcaccatggctttcattgccaagtccttctatgacctcagtgccatcagcctggatggggagaaggtagatttcaatacgttccggggcagggccgtgctgattgagaatgtggcttcgctcggcacaaccacccgggacttcacccagctcaacgagctgcaatgccgctttcccaggcgcctggtggtccttggcttcccttgcaaccaatttggacatcaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggaaacggcc

SEQ ID NO: 137744 - DNA, 1636 bp, Homo sapiens
  Payload ID: 6974
  Gene Symbol: GPX3
  Gene Name: glutathione peroxidase 3
  Uniprot ID: P22352
  ENST ID: ENST00000388825
  CDS Start-End: 93-773
aaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctga

SEQ ID NO: 137745 - DNA, 467 bp, Homo sapiens
  Payload ID: 6974
  Gene Symbol: GPX3
  Gene Name: glutathione peroxidase 3
  ENST ID: ENST00000521650
  CDS Start-End: 52-467
ccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaaggctccccgccagatgggcaatccccagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccc

SEQ ID NO: 137746 - DNA, 316 bp, Homo sapiens
  Payload ID: 6974
  Gene Symbol: GPX3
  Gene Name: glutathione peroxidase 3
  ENST ID: ENST00000520059
  CDS Start-End: 1-239
aatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagggccaggctattccccaggaaggcctgggaaggaagagggtcagggggcctcaagcaaggttgacactcctcttatccctgctctagaactcctgtcctcccacctcggagctcctgggtacatctgaccgcctcttctgggaacccatgaaggttcacgacat

SEQ ID NO: 137747 - DNA, 612 bp, Homo sapiens
  Payload ID: 6974
  Gene Symbol: GPX3
  Gene Name: glutathione peroxidase 3
  ENST ID: ENST00000517973
  CDS Start-End: 50-352
agggatcaggcagcggctcaggcgaccctgagtgtgcccccaccccgccatggcccggctgctgcaggcgtcctgcctgctttccctgctcctggccggcttcgtctcgcagagccggggacaagagaagtcgaagaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggg

SEQ ID NO: 137748 - DNA, 834 bp, Homo sapiens
  Payload ID: 6974
  Gene Symbol: GPX3
  Gene Name: glutathione peroxidase 3
  ENST ID: ENST00000519214
  CDS Start-End: 50-241
agggatcaggcagcggctcaggcgaccctgagtgtgcccccaccccgccatggcccggctgctgcaggcgtcctgcctgctttccctgctcctggccggcttcgtctcgcagagccggggacaagagaagtcgaaggctccccgccagatgggcaatccccaggtgcgagagacctcctgaaccccttttgccgccccctccgccgccgggaccccgcccccgaccgtcgtcgtctcgtagttccatctgttggagagccgagacctggtgcttcaggcgggcagaatgactaagggaggaaggtctctctccccgagctcgcactttctccccactgccacctcgagggtcgccttgctacatctatgtcacctccgtgcctgagctgctccccttcagtagggcctaagagggagggcgtcacagaaaaaaatgcccagcgtctgggtgggctgtgcaagttcccagggagagagacaaggagaaaggagagaggcagctgggtggtcctggtcctgaagaactgctgtggggggctcttctaccccaagaatgatacagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaa

SEQ ID NO: 137749 - DNA, 1314 bp, Homo sapiens
  Payload ID: 6974
  Gene Symbol: GPX3
  Gene Name: glutathione peroxidase 3
  ENST ID: ENST00000521632
  CDS Start-End: 1-524
actgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaaaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactc

SEQ ID NO: 137750 - DNA, 1478 bp, Homo sapiens
  Payload ID: 6974
  Gene Symbol: GPX3
  Gene Name: glutathione peroxidase 3
  ENST ID: ENST00000614343
  CDS Start-End: 67-285
tcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatgctccttcggaggacgtgccctcacccctcactggtccactggcttgagactcaccccgtctgcccagtaaaagcctttctgcagc

SEQ ID NO: 137751 - DNA, 1757 bp, Homo sapiens
  Payload ID: 6974
  Gene Symbol: GPX3
  Gene Name: glutathione peroxidase 3
  ENST ID: ENST00000622181
  CDS Start-End: 218-895
gtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctacggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctg

SEQ ID NO: 137752 - DNA, 919 bp, Homo sapiens
  Payload ID: 6975
  Gene Symbol: GPX4
  Gene Name: glutathione peroxidase 4
  Uniprot ID: P36969
  ENST ID: ENST00000354171
  CDS Start-End: 108-701
gagcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctggatc

SEQ ID NO: 137753 - DNA, 803 bp, Homo sapiens
  Payload ID: 6975
  Gene Symbol: GPX4
  Gene Name: glutathione peroxidase 4
  ENST ID: ENST00000588919
  CDS Start-End: 53-781
gaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagtttggacaccgtctctccacagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgga

SEQ ID NO: 137754 - DNA, 583 bp, Homo sapiens
  Payload ID: 6975
  Gene Symbol: GPX4
  Gene Name: glutathione peroxidase 4
  ENST ID: ENST00000593032
  CDS Start-End: 59-583
cctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaagacagcttggggactgtggggggctgctggggacgctcacgtccatgtgcttcttttccagtgccatcaagtggaacttcaccaagttcctcatcgacaagaacggctgcgtggtgaagcgctacggacc

SEQ ID NO: 137755 - DNA, 812 bp, Homo sapiens
  Payload ID: 6975
  Gene Symbol: GPX4
  Gene Name: glutathione peroxidase 4
  ENST ID: ENST00000589115
  CDS Start-End: 37-579
cgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaattcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattag

SEQ ID NO: 137756 - DNA, 501 bp, Homo sapiens
  Payload ID: 6975
  Gene Symbol: GPX4
  Gene Name: glutathione peroxidase 4
  ENST ID: ENST00000585480
  CDS Start-End: 1-501
tacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctgctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattag

SEQ ID NO: 137757 - DNA, 536 bp, Homo sapiens
  Payload ID: 6975
  Gene Symbol: GPX4
  Gene Name: glutathione peroxidase 4
  ENST ID: ENST00000587648
  CDS Start-End: 71-536
ccacgctccctgctcagcttcctttgccttgcagtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccact

SEQ ID NO: 137758 - DNA, 859 bp, Homo sapiens
  Payload ID: 6975
  Gene Symbol: GPX4
  Gene Name: glutathione peroxidase 4
  ENST ID: ENST00000585362
  CDS Start-End: 321-859
tgcaggcgcgcgtgccggggccggggtcgggggtccaggcttgcagggggcggggtccgggacggctggggcggagctggaccgttgagggccacggcggggcgtctccgggccgagcggggctgctgcgcccgagcggttgggggcgcggagggctggaaatcccggatcacgcgcccccgggcgccgccccgcccccgcaccttggcctagcgcggtggcgtcacagtcgcgcagtcctgactacggcctccgggccctttgtccccgctagcggcgctcggggtgggggagccaggaggggcgggagacgggcgggtatgggccgcgcgggcgcaggctcccccgggcgccgcaggcagcggtgccagagccggggcaggcggcggccgcgagcccctcggcggcggaaggccccagcgtgcaggcgcaggagggcgcggcgccggcggaagaagccctgtccccgcagcttgcgaccggagatccacgaatgtcccaagtcccaggacccgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgct

SEQ ID NO: 137759 - DNA, 1002 bp, Homo sapiens
  Payload ID: 6975
  Gene Symbol: GPX4
  Gene Name: glutathione peroxidase 4
  ENST ID: ENST00000622390
  CDS Start-End: 86-787
agtcctgactacggcctccgggccctttgtccccgctagcggcgctcggggtgggggagccaggaggggcgggagacgggcgggtatgggccgcgcgggcgcaggctcccccgggcgccgcaggcagcggtgccagagccggggcaggcggcggccgcgagcccctcggcggcggaaggccccagcgtgcaggcgcaggagggcgcggcgccggcggaagaagccctgtccccgcagcttgcgaccggagatccacgaatgtcccaagtcccaggacccgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgg

SEQ ID NO: 137760 - DNA, 793 bp, Homo sapiens
  Payload ID: 6975
  Gene Symbol: GPX4
  Gene Name: glutathione peroxidase 4
  Uniprot ID: P36969
  ENST ID: ENST00000611653
  CDS Start-End: 74-586
cggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattag

SEQ ID NO: 137761 - DNA, 431 bp, Homo sapiens
  Payload ID: 6975
  Gene Symbol: GPX4
  Gene Name: glutathione peroxidase 4
  ENST ID: ENST00000614791
  CDS Start-End: 30-431
gagccaggaggggcgggagacgggcgggtatgggccgcgcgggcgcaggctcccccgggcgccgcaggcagcggtgccagagccggggcaggcggcggccgcgagcccctcggcggcggaaggccccagcgtgcaggcgcaggagggcgcggcgccggcggaagaagccctgtccccgcagcttgcgaccggagatccacgaatgtcccaagtcccaggacccgtgcgcgtcccgggacgactggcgctgtgcgcgctccatgcacgagttttccgccaaggacatcgacgggcacatggttaacctggacaagggcttcgtgtgcatcgtcaccaacgtggcctcccagtgaggcaagaccgaagtaaactacactcagctcgtcgacctgcacgcccgatacgctgagtgtggtttgcggatcctggcc

SEQ ID NO: 137762 - DNA, 924 bp, Homo sapiens
  Payload ID: 6975
  Gene Symbol: GPX4
  Gene Name: glutathione peroxidase 4
  ENST ID: ENST00000616066
  CDS Start-End: 119-709
gtctgaccaatgagcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctgg

SEQ ID NO: 137763 - DNA, 1540 bp, Homo sapiens
  Payload ID: 6976
  Gene Symbol: GPX5
  Gene Name: glutathione peroxidase 5
  Uniprot ID: O75715
  ENST ID: ENST00000412168
  CDS Start-End: 90-755
ttgggctaagtccctgccaagataccaaaagactgcagaggtgggcaaagacctcaggcccccagactagcaatctacaaacactagtcatgactacacagttaagggtcgtccatctgcttccccttctcctagcctgctttgtgcaaacaagtcccaagcaggagaagatgaagatggattgccacaaagacgagaaaggcaccatctatgactatgaggccatcgcacttaataagaatgaatatgtttccttcaagcagtatgtgggcaagcacatcctcttcgtcaacgtggccacctactgtggtctgacagcgcaatatcctgaactaaatgcactccaggaggagctgaagccctatggtctagttgtgttgggctttccctgcaaccaatttggaaagcaagaaccaggagataacaaagagattcttcctgggctcaagtatgtccgtccagggggaggatttgtacctagtttccagctttttgagaaaggggatgtgaatggtgaaaaagaacagaaagtcttcagtttcttgaagcactcctgtcctcatccctctgagattttgggcacattcaaatctatatcctgggaccctgtaaaggtccatgacatccgttggaactttgaaaagttcctggtggggcctgatggaatccctgtcatgcgctggtcccaccgggctacggtcagctcagtcaagacagacatcctggcgtacttgaagcaattcaaaaccaaataggaaggtggagttaagggcaggagcaaccctacttctcacctaatgacttgctctccccacccctccaaaaaaaaggaatacccatcttctcaccacactctcttcctgcatgggctccacctgagtaaatcaccgccacatactgccagaattcccactctccacaaactagatttatatttggaaggctactgctcttttgcctctcaagagtatgtgggtgaagactgaaacaaatggaaacctaaaatccccagacctctgttacaggttgaatcattcatatccaccagagggaaatcatccttccacgacaatggttcagtcggccatcacatcctgaagaacattcctagacattctgactcttccatctctctctaccctggaggtgtagaaatagcaatggggtcacagtcacacaatttaggttccacttcataacattttttgtctcctaggacaaacgtgtatcatcagtttccaactgttttggctcagttttcatccatgacacctccccctaccagccattctcctgtgggagcaagaacattgcttcaaaagaagagagggcatctccatgcttgtgggacccaaaacctatctctggccctacaaaagttttcctaattgtctgatctttagtgcattcaggttatggcacctggagaggaatgccctttatcttttgaaggatgggatttcccatctcaaccctggattcctcaccttcagaacgagccctgccactgtctccaataaaatgttttctgcagcatcga

SEQ ID NO: 137764 - DNA, 428 bp, Homo sapiens
  Payload ID: 6976
  Gene Symbol: GPX5
  Gene Name: glutathione peroxidase 5
  Uniprot ID: O75715
  ENST ID: ENST00000469384
  CDS Start-End: 3-305
tcatgactacacagttaagggtcgtccatctgcttccccttctcctagcctgctttgtgcaaacaagtcccaagcaggagaagatgaagatggattgccacaaagacgagaaaggcaccatctatgactatgaggccatcgcacttaataagaatgaatatgtttccttcaagcagtatgtgggcaagcacatcctcttcgtcaacgtggccacctactgtggtctgacagcgcaatatcctggtatgtccgtccagggggaggatttgtacctagtttccagctttttgagaaaggggatgtgaatggtgaaaaagaacagaaagtcttcagtttcttgaagcactcctgtcctcatccctctgagattttgggcacattcaaatctatatcctgggaccctgtaaaggtccatgacatccgttgga

SEQ ID NO: 137765 - DNA, 1334 bp, Homo sapiens
  Payload ID: 6976
  Gene Symbol: GPX5
  Gene Name: glutathione peroxidase 5
  ENST ID: ENST00000551639
  CDS Start-End: 3-305
tcatgactacacagttaagggtcgtccatctgcttccccttctcctagcctgctttgtgcaaacaagtcccaagcaggagaagatgaagatggattgccacaaagacgagaaaggcaccatctatgactatgaggccatcgcacttaataagaatgaatatgtttccttcaagcagtatgtgggcaagcacatcctcttcgtcaacgtggccacctactgtggtctgacagcgcaatatcctggtatgtccgtccagggggaggatttgtacctagtttccagctttttgagaaaggggatgtgaatggtgaaaaagaacagaaagtcttcagtttcttgaagcactcctgtcctcatccctctgagattttgggcacattcaaatctatatcctgggaccctgtaaaggtccatgacatccgttggaactttgaaaagttcctggtggggcctgatggaatccctgtcatgcgctggtcccaccgggctacggtcagctcagtcaagacagacatcctggcgtacttgaagcaattcaaaaccaaataggaaggtggagttaagggcaggagcaaccctacttctcacctaatgacttgctctccccacccctccaaaaaaaaggaatacccatcttctcaccacactctcttcctgcatgggctccacctgagtaaatcaccgccacatactgccagaattcccactctccacaaactagatttatatttggaaggctactgctcttttgcctctcaagagtatgtgggtgaagactgaaacaaatggaaacctaaaatccccagacctctgttacaggttgaatcattcatatccaccagagggaaatcatccttccacgacaatggttcagtcggccatcacatcctgaagaacattcctagacattctgactcttccatctctctctaccctggaggtgtagaaatagcaatggggtcacagtcacacaatttaggttccacttcataacattttttgtctcctaggacaaacgtgtatcatcagtttccaactgttttggctcagttttcatccatgacacctccccctaccagccattctcctgtgggagcaagaacattgcttcaaaagaagagagggcatctccatgcttgtgggacccaaaacctatctctggccctacaaaagttttcctaattgtctgatctttagtgcattcaggttatggcacctggagaggaatgccctttatcttttgaaggatgggatttcccatctcaaccctggattcctcaccttcagaacgagccctgccactgtctccaataaaatgttttctgcagcatcg

SEQ ID NO: 137766 - DNA, 1452 bp, Homo sapiens
  Payload ID: 6976
  Gene Symbol: GPX5
  Gene Name: glutathione peroxidase 5
  ENST ID: ENST00000550775
  CDS Start-End: 3-668
tcatgactacacagttaagggtcgtccatctgcttccccttctcctagcctgctttgtgcaaacaagtcccaagcaggagaagatgaagatggattgccacaaagacgagaaaggcaccatctatgactatgaggccatcgcacttaataagaatgaatatgtttccttcaagcagtatgtgggcaagcacatcctcttcgtcaacgtggccacctactgtggtctgacagcgcaatatcctgaactaaatgcactccaggaggagctgaagccctatggtctagttgtgttgggctttccctgcaaccaatttggaaagcaagaaccaggagataacaaagagattcttcctgggctcaagtatgtccgtccagggggaggatttgtacctagtttccagctttttgagaaaggggatgtgaatggtgaaaaagaacagaaagtcttcagtttcttgaagcactcctgtcctcatccctctgagattttgggcacattcaaatctatatcctgggaccctgtaaaggtccatgacatccgttggaactttgaaaagttcctggtggggcctgatggaatccctgtcatgcgctggtcccaccgggctacggtcagctcagtcaagacagacatcctggcgtacttgaagcaattcaaaaccaaataggaaggtggagttaagggcaggagcaaccctacttctcacctaatgacttgctctccccacccctccaaaaaaaaggaatacccatcttctcaccacactctcttcctgcatgggctccacctgagtaaatcaccgccacatactgccagaattcccactctccacaaactagatttatatttggaaggctactgctcttttgcctctcaagagtatgtgggtgaagactgaaacaaatggaaacctaaaatccccagacctctgttacaggttgaatcattcatatccaccagagggaaatcatccttccacgacaatggttcagtcggccatcacatcctgaagaacattcctagacattctgactcttccatctctctctaccctggaggtgtagaaatagcaatggggtcacagtcacacaatttaggttccacttcataacattttttgtctcctaggacaaacgtgtatcatcagtttccaactgttttggctcagttttcatccatgacacctccccctaccagccattctcctgtgggagcaagaacattgcttcaaaagaagagagggcatctccatgcttgtgggacccaaaacctatctctggccctacaaaagttttcctaattgtctgatctttagtgcattcaggttatggcacctggagaggaatgccctttatcttttgaaggatgggatttcccatctcaaccctggattcctcaccttcagaacgagccctgccactgtctccaataaaatgttttctgcagcatcg

SEQ ID NO: 137767 - DNA, 1712 bp, Homo sapiens
  Payload ID: 6977
  Gene Symbol: GPX6
  Gene Name: glutathione peroxidase 6
  Uniprot ID: P59796
  ENST ID: ENST00000361902
  CDS Start-End: 51-716
aaaaggggctgaaatcctggggacctcagagtcgtctaaaactcctagccatgttccagcagttccaggcctcctgtcttgtcctgtttttcctggttggctttgctcagcagaccctaaagcctcaaaataggaaggtggattgcaacaaaggggtaacaggcaccatctatgagtatggagccctcaccctcaacggcgaggagtacatccaattcaagcagtttgcaggcaagcacgtcctgtttgtcaatgtggccgcctattgaggcttggcagctcagtatcctgaactgaatgcactacaggaggagctgaagaattttggtgtcattgtgttggcctttccctgcaaccagtttggaaaacaagaaccaggaacaaactcagaaatacttcttggtctcaagtatgtgtgtccaggtagtggctttgtccccagtttccagctctttgagaaaggggatgtgaatggagaaaaagaacagaaggtctttactttcctgaagaactcctgccctccgacctctgatcttttgggctcatcaagccaactcttctgggagcccatgaaggtccatgatatccgctggaactttgagaaatttctggtggggcccgatggagtccctgtcatgcattggttccaccaggctccagtcagcacagtcaagtcagacatcctggagtacctaaagcagttcaatacccactaggaagggctagcgactgacagaaataactaccctgtctcccacctgcaggaatgtctaacaaagcatccatcttcctccttctttgctccacactcgtgcctacccagcctcctgatgaccaaaccatcctgtactacccaagcacctgcttagcatgtgtgtgtagctgtgtgtgtgtgtgtgtgtgtgtgtatggatatgtagaattgtatttgttggtatatgcataggtgtatgtatggtgtgtgtgtgtgtgtgtgtgtgtgtgtttgaagattaaggaaaagaacacctatctctccaactctctgatcctgaaatatctattccaaaggaaaatcatattttagggtagatgaatcagactatcctgtgtccctaaaaaagcaatcccgagaagttgtgacatctatcccttccccttcctgaaagttttaaagaaagcaggagctggccgcaagactctaggcctccttcatagcctctctcctctaagataggcatgcattgttaaactcttttctccttaattctcctttattcccctgccacccagtagttctcatgtaggacctctgaaggcagagtgagagcagaaaccccacctcacatgaagggaagggcatctccatgatggtggatcccaaaacccctctgggtcgcaccctgccagagccttccttggtgcctgtcccttagtgcattcaggtcatggcacctgggcaggggtgtccctgtattctgaatgatgggctttctcctcaccctgagcctcctcaactttaagcttattttgatcactgtctcaaatttaaaaattctgcagcaacctggctctgtgtggtgttttcccagtcccatattatgtccagtcatacttcttctttctctgtcactttgtccctgctttcttgattcccttgtcttgttcttcagtattttgtttttctcaaaaatgctctagaactttccttggcacatataaaagcacggctg

SEQ ID NO: 137768 - DNA, 716 bp, Homo sapiens
  Payload ID: 6977
  Gene Symbol: GPX6
  Gene Name: glutathione peroxidase 6
  ENST ID: ENST00000474923
  CDS Start-End: 45-590
ggctgaaatcctggggacctcagagtcgtctaaaactcctagccatgttccagcagttccaggcctcctgtcttgtcctgtttttcctggttggctttgctcagcagaccctaaagcctcaaaataggaaggtggattgcaacaaaggggtaacaggcaccatctatgagtatggagccctcaccctcaacggcgaggagtacatccaattcaagcagtttgcaggcaagcacgtcctgtttgtcaatgtggccgcctattgaggcttggcagctcagtatcctgaactgaatgcactacaggaggagctgaagaattttggtgtcattgtgttggcctttccctgcaaccagtttggaaaacaagaaccaggaacaaactcagaaatacttcttggtctcaaaactcctgccctccgacctctgatcttttgggctcatcaagccaactcttctgggagcccatgaaggtccatgatatccgctggaactttgagaaatttctggtggggcccgatggagtccctgtcatgcattggttccaccaggctccagtcagcacagtcaagtcagacatcctggagtacctaaagcagttcaatacccactaggaagggctagcgactgacagaaataactaccctgtctcccacctgcaggaatgtctaacaaagcatccatcttcctccttctttgctccacactcgtgcctaccca

SEQ ID NO: 137769 - DNA, 1709 bp, Homo sapiens
  Payload ID: 6977
  Gene Symbol: GPX6
  Gene Name: glutathione peroxidase 6
  ENST ID: ENST00000612264
  CDS Start-End: 51-713
aaaaggggctgaaatcctggggacctcagagtcgtctaaaactcctagccatgttccagcagttccaggcctcctgtcttgtcctgtttttcctggttggctttgctcagcagaccctaaagcctcaaaataggaaggtggattgcaacaaaggggtaacaggcaccatctatgagtatggagccctcaccctcaacggcgaggagtacatccaattcaagcagtttgcaggcaagcacgtcctgtttgtcaatgtggccgcctatggcttggcagctcagtatcctgaactgaatgcactacaggaggagctgaagaattttggtgtcattgtgttggcctttccctgcaaccagtttggaaaacaagaaccaggaacaaactcagaaatacttcttggtctcaagtatgtgtgtccaggtagtggctttgtccccagtttccagctctttgagaaaggggatgtgaatggagaaaaagaacagaaggtctttactttcctgaagaactcctgccctccgacctctgatcttttgggctcatcaagccaactcttctgggagcccatgaaggtccatgatatccgctggaactttgagaaatttctggtggggcccgatggagtccctgtcatgcattggttccaccaggctccagtcagcacagtcaagtcagacatcctggagtacctaaagcagttcaatacccactaggaagggctagcgactgacagaaataactaccctgtctcccacctgcaggaatgtctaacaaagcatccatcttcctccttctttgctccacactcgtgcctacccagcctcctgatgaccaaaccatcctgtactacccaagcacctgcttagcatgtgtgtgtagctgtgtgtgtgtgtgtgtgtgtgtgtatggatatgtagaattgtatttgttggtatatgcataggtgtatgtatggtgtgtgtgtgtgtgtgtgtgtgtgtgtttgaagattaaggaaaagaacacctatctctccaactctctgatcctgaaatatctattccaaaggaaaatcatattttagggtagatgaatcagactatcctgtgtccctaaaaaagcaatcccgagaagttgtgacatctatcccttccccttcctgaaagttttaaagaaagcaggagctggccgcaagactctaggcctccttcatagcctctctcctctaagataggcatgcattgttaaactcttttctccttaattctcctttattcccctgccacccagtagttctcatgtaggacctctgaaggcagagtgagagcagaaaccccacctcacatgaagggaagggcatctccatgatggtggatcccaaaacccctctgggtcgcaccctgccagagccttccttggtgcctgtcccttagtgcattcaggtcatggcacctgggcaggggtgtccctgtattctgaatgatgggctttctcctcaccctgagcctcctcaactttaagcttattttgatcactgtctcaaatttaaaaattctgcagcaacctggctctgtgtggtgttttcccagtcccatattatgtccagtcatacttcttctttctctgtcactttgtccctgctttcttgattcccttgtcttgttcttcagtattttgtttttctcaaaaatgctctagaactttccttggcacatataaaagcacggctg

SEQ ID NO: 137770 - DNA, 219 bp, Homo sapiens
  Payload ID: 6977
  Gene Symbol: GPX6
  Gene Name: glutathione peroxidase 6
  ENST ID: ENST00000627846
  CDS Start-End: 1-219
atgttccagcagttccaggcctcctgtcttgtcctgtttttcctggttggctttgctcagcagaccctaaagcctcaaaataggaaggtggattgcaacaaaggggtaacaggcaccatctatgagtatggagccctcaccctcaacggcgaggagtacatccaattcaagcagtttgcaggcaagcacgtcctgtttgtcaatgtggccgcctattga

SEQ ID NO: 137771 - DNA, 1228 bp, Homo sapiens
  Payload ID: 6978
  Gene Symbol: GPX7
  Gene Name: glutathione peroxidase 7
  Uniprot ID: Q96SL4
  ENST ID: ENST00000361314
  CDS Start-End: 39-602
tctttgccctcgcgacgccgccacctccggaacaagccatggtggcggcgacggtggcagcggcgtggctgctcctgtgggctgcggcctgcgcgcagcaggagcaggacttctacgacttcaaggcggtcaacatccggggcaaactggtgtcgctggagaagtaccgcggatcggtgtccctggtggtgaatgtggccagcgagtgcggcttcacagaccagcactaccgagccctgcagcagctgcagcgagacctgggcccccaccactttaacgtgctcgccttcccctgcaaccagtttggccaacaggagcctgacagcaacaaggagattgagagctttgcccgccgcacctacagtgtctcattccccatgtttagcaagattgcagtcaccggtactggtgcccatcctgccttcaagtacctggcccagacttctgggaaggagcccacctggaacttctggaagtacctagtagccccagatggaaaggtggtaggggcttgggacccaactgtgtcagtggaggaggtcagaccccagatcacagcgctcgtgaggaagctcatcctactgaagcgagaagacttataaccaccgcgtctcctcctccaccacctcatcccgcccacctgtgtggggctgaccaatgcaaactcaaatggtgcttcaaagggagagacccactgactctccttcctttactcttatgccattggtcccatcattcttgtgggggaaaaattctagtattttgattatttgaatcttacagcaacaaataggaactcctggccaatgagagctcttgaccagtgaatcaccagccgatacgaacgtcttgccaacaaaaatgtgtggcaaatagaagtatatcaagcaataatctcccacccaaggcttctgtaaactgggaccaatgattacctcatagggctgttgtgaggattaggatgaaatacctgtgaaagtgcctaggcagtgccagccaaataggaggcattcaatgaacattttttgcatataaaccaaaaaataacttgttatcaataaaaacttgcatccaacatgaatttccagccgatgataatccaggccaaaggtttagttgttgttatttcctctgtattattttcttcattacaaaagaaatgcaagttcattgtaacaatccaaacaatacctcacgatataaaataaaaatgaaagtatcctcctca

SEQ ID NO: 137772 - DNA, 3245 bp, Homo sapiens
  Payload ID: 6979
  Gene Symbol: GPX8
  Gene Name: glutathione peroxidase 8 (putative)
  ENST ID: ENST00000296734
  CDS Start-End: 25-297
gacttccctctagaatcctccaacatggagcctcttgcagcttacccgctaaaatgttccgggcccagagcaaaggtatttgcagttttgctgtctatagttctatgcacagtaacgctatttcttctacaactaaaattcctcaaacctaaaatcaacagcttttatgcctttgaagtgaaggatgcaaaaggaagaactgtttctctggaaaagtataaaggcaaaattcttcaaagaaggaaccaaggtggaatttttggaagtatcttgtcaaccctgagggtcaagttgtgaagttctggaagccagaggagcccattgaagtcatcaggcctgacatagcagctctggttagacaagtgatcataaaaaagaaagaggatctatgagaatgccattgcgtttctaatagaacagagaaatgtctccatgagggtttggtctcattttaaacattttttttttggagacagtgtctcactctgtcacccaggctggagtgcagtagtgcgttctcagctcattgcaacctctgcctttttaaacatgctattaaatgtggcaatgaaggatttttttttaatgttatcttgctattaagtggtaatgaatgttcccaggatgaggatgttacccaaagcaaaaatcaagagtagccaaagaatcaacatgaaatatattaactacttcctctgaccatactaaagaattcagaatacacagtgaccaatgtgcctcaatatcttattgttcaacttgacattttctaggactgtacttgatgaaaatgccaacacactagaccactctttggattcaagagcactgtgtatgactgaaatttctggaataactgtaaatggttatgttaatggaataaaacacaaatgttgaaaaatgtaaaatatatatacatagattcaaatccttatatatgtatgcttgttttgtgtacaggattttgttttttctttttaagtacaggttcctagtgttttactataactgtcactatgtatgtaactgacatatataaatagtcatttataaatgaccgtattataacatttgaaaaagtcttcatcattttcagtatttctctctgcattattttttagaagcaactcaaattctgtaatcataatattaccaagtaagtcagtctttatttttgcgtgaaaatcccaagtgtagaaaaaaggacatgagtataagatcatttaacttgattccttataggctgatttgggttgctaatgtattcgtactagattagccacttgggaggaattcaatgctgcatcattctgatagctgaaatagtaaaagtcaactccaaacagcctaaattctagtataaaaagggggtgatcatacaagtcctaaagtgtagatcagcagtcactgaacctcttagagtcacaaggcatttcttctcccaaagtcatgacctttatattttgttagccttataattgactaacaaagcaacctgccaagttggtgaaggttaattattgcctcatgaaatatacattcatcgcataaaagaattaaataggaagatggccaaaaatgtaaaaaagtcgtataaatttgtctaagaagaaaaagacccaatttaagtagtctgtgacttgactcccaaattctgacctgatggatgaaagtgaagatgtttcgtatggcaaattcagtaatgctacctcagtatatagttctgtatacgtatttggaccaaagttattagataaaccaaaaatatttcatgaagcatcttctgcttcagagtccatatccagccacccagctatgaatgtatttagaaagatatttggtggaggtggaatttctaccagaggtcaagaggatttgtagggatagcctcaagaatgccagatgagtgtgtcagaaagcctgctcctacctctcgccagctgcgtgactttaggcaagtcacttaagtaccttatttcagtttcctcacctgtaaattgaacaggggttgaatggaataaaaagccctttgcaactctaaaagtcaattaacacacttactaaggtgttttaagtgaccaggaaggaaatcagaactaacctggattgttagcgaagaaaacagaagccaccaacaagcctatctgtcctttgcaattttgctccaagagcctattagcaatttgaattctgagcctctaagaaaacttatgctcaggtggcccctccaagtgttggtgccagagcactcttgccttgtatcctcacctacgccttccatgaactcatagcagtgctgtggcactgcaggggtgttttatgcattcacgttaggagcatgagcagaactgcatatgccagcaccacatgggcagcagagactccccactgccagatggatgataatggagctgcactgggaacaaccaggactgtcccagtcaacatgatacagatgaacatcctgccttaagtcactagctctctccaaagccagataaagtgggtttcttcacttacatctctctaatcttggctgccttattcaacctacagactctatgtcagtgctggattttctccccttgccctttaggtaagcagagtaggcaggaggagatttgaaagcgtgtcatacatattgccttgaaagaaaggacattcaggtgtcccttcggggttctgtaacaattaggctatgtgtgctgagagagggagcggagtcatttgctgatgtgctgctacctgtaactcaaatgcctcataggaataccagcggacaaacacatagaggaaaagttgaatctttcctatattggacaatcttccttcagtcttgtttctgcatcaaaaagtctgggacacagagtgctacaggatgcctgggctaaggactgtaacagaaaaatatcaacatcagagcctggcacagtggctcacaccggtaatcccagcactttgggaggccgaggcgggtggatcacttcaggtcaggagttcgagaccatcctggccaacatggtgaaacccccatctctactaaaaatacaaaaattagccgggcacggtggcacatgcctgtaatcccagctacctgggaggctgagtcagaagaatcacttgaaaacaggaggctgaggttgcaatgagccaagattgcaccactgcactccaacctgggcaacagagcgagaccccatcttaaagaccctgtctcaaaaaagagagaaaaagaaaaagaaaaa

SEQ ID NO: 137773 - DNA, 1411 bp, Homo sapiens
  Payload ID: 6979
  Gene Symbol: GPX8
  Gene Name: glutathione peroxidase 8 (putative)
  Uniprot ID: Q8TED1
  ENST ID: ENST00000503787
  CDS Start-End: 76-705
aaactaagccggtttcaagtttcagctcctccttgaattccaggctgctgagacttccctctagaatcctccaacatggagcctcttgcagcttacccgctaaaatgttccgggcccagagcaaaggtatttgcagttttgctgtctatagttctatgcacagtaacgctatttcttctacaactaaaattcctcaaacctaaaatcaacagcttttatgcctttgaagtgaaggatgcaaaaggaagaactgtttctctggaaaagtataaaggcaaagtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaacctgcatttagatttcttgttgattcttcaaagaaggaaccaaggtggaatttttggaagtatcttgtcaaccctgagggtcaagttgtgaagttctggaagccagaggagcccattgaagtcatcaggcctgacatagcagctctggttagacaagtgatcataaaaaagaaagaggatctatgagaatgccattgcgtttctaatagaacagagaaatgtctccatgagggtttggtctcattttaaacattttttttttggagacagtgtctcactctgtcacccaggctggagtgcagtagtgcgttctcagctcattgcaacctctgcctttttaaacatgctattaaatgtggcaatgaaggatttttttttaatgttatcttgctattaagtggtaatgaatgttcccaggatgaggatgttacccaaagcaaaaatcaagagtagccaaagaatcaacatgaaatatattaactacttcctctgaccatactaaagaattcagaatacacagtgaccaatgtgcctcaatatcttattgttcaacttgacattttctaggactgtacttgatgaaaatgccaacacactagaccactctttggattcaagagcactgtgtatgactgaaatttctggaataactgtaaatggttatgttaatggaataaaacacaaatgttgaaaaatgtaaaatatatatacatagattcaaatccttatatatgtatgcttgttttgtgtacaggattttgttttttctttttaagtacaggttcctagtgttttactataactgtcactatgtatgtaactgacatatataaatagtcatttataaatgaccgtattataacatttgaaaaagtcttcatcattttcagta

SEQ ID NO: 137774 - DNA, 1036 bp, Homo sapiens
  Payload ID: 6979
  Gene Symbol: GPX8
  Gene Name: glutathione peroxidase 8 (putative)
  ENST ID: ENST00000515370
  CDS Start-End: 24-500
acttccctctagaatcctccaacatggagcctcttgcagcttacccgctaaaatgttccgggcccagagcaaaggtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaacctgcatttagatttcttgttgattcttcaaagaaggaaccaaggtggaatttttggaagtatcttgtcaaccctgagggtcaagttgtgaagttctggaagccagaggagcccattgaagtcatcaggcctgacatagcagctctggttagacaagtgatcataaaaaagaaagaggatctatgagaatgccattgcgtttctaatagaacagagaaatgtctccatgagggtttggtctcattttaaacattttttttttggagacagtgtctcactctgtcacccaggctggagtgcagtagtgcgttctcagctcattgcaacctctgcctttttaaacatgctattaaatgtggcaatgaaggatttttttttaatgttatcttgctattaagtggtaatgaatgttcccaggatgaggatgttacccaaagcaaaaatcaagagtagccaaagaatcaacatgaaatatattaactacttcctctgaccatactaaagaattcagaatacacagtgaccaatgtgcctcaatatcttattgttcaacttgacattttctaggactgtacttgatgaaaatgccaacacactagaccactctttggattcaagagcactgtgtatgactgaaatttctggaataactgtaaatggttatgttaatggaataaaacacaaatgttgaaaaatgtaaaatatatatacatagattcaaa

SEQ ID NO: 137775 - DNA, 3119 bp, Homo sapiens
  Payload ID: 6980
  Gene Symbol: GSR
  Gene Name: glutathione reductase
  Uniprot ID: P00390
  ENST ID: ENST00000221130
  CDS Start-End: 92-1660
gtgaggctgcgcttgcccggggcccgcgcccccctaccccggggaccgcccccgggccgcccgccccacttggcgcgccacttccgcgtgcatggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagacatcactgatgatacggcatgataaggtacttagaagttttgattcaatgatcagcaccaactgcacggaggagctggagaacgctggcgtggaggtgctgaagttctcccaggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttgagaaccaggagacacgtgtggcgggcagtgggacccatagatcttctgaaatgaaacaaataatcacattgacttactgtttgagttttatgtatttctttattttaatcaggatcttctgatagtggaaatttttagtacataatagaacttatttatggagttagaaatttgtagtgttatccaggattgattttcatttgatcacatctcacagtaattaatattttcaagttttttttttattaacagctctgtgctagttttttttttctgttttagcctcatcccaaatataaagctttgtgaagtacaattaacttaatgtacttgaatgaatagaacttgctactttttttttttttttttttgagacagagttttgctctcattgcccaggctggagtgcggtggtgctatttcagctcaccacaacctctgcctcctgggttcaagtgattctcctgccttagcctcccgaatagctggaattacaggcacgcaccaccatgcctgactaattttgtatttttagtagacatggggtttctccatgttggtcaggctggtctcaaactcccaccttcaggtgatccgcccacctcggcctcctgaggtgctgagattacaggcgtgagccactgtgccagcttgctaattttcacagaagttgatggcaattcttcacatgtaaacagtgccagtgcacagaacctttatatattttttgaagccagtactgtgctctgcatataacaaagctgcttcaaggatgagacctttttctaaaagcatgtaatgtgagaagccggcctgccttattttcttttttcttttttaatgattaaaaatagtttgtggcaaggcacggtggctcaggcctgtaattctagcactttgggaggccgaggcaggaggattacttgagcctacaagtttgaggccagcatgcacagcatagcaagactgcatctctacagagagtaaaaaaaattacccgagtgtggtgatgtgcatctgtaatctcagctacttgggaggctgaggtgagaggatcacttgagcttgggtgaggtgaggctgcagtgagtcctgatcatgctgctgcactcaatcttggacaacagagcaagaccctgtctcaaaaaaaaaaaaaaaaaatatatatatatatatatattatttttatgaggtgaagtgcatcaaacttgggaaagatttgaggaggctgggaacctcctggaaaaccactccttgaagaaagatatgagagacatttagaagtgattcctgctttcagaaggaggtggattcaaatacatcaaaagtcccttcctctgctaagtgtttatagttcaatgaataatttcaatatttgtatgtgttcttgtcattttatttttttctgaaaaacttccaaaaatttgaaaataaaattacagccttttcttcttataaaa

SEQ ID NO: 137776 - DNA, 582 bp, Homo sapiens
  Payload ID: 6980
  Gene Symbol: GSR
  Gene Name: glutathione reductase
  ENST ID: ENST00000521479
  CDS Start-End: 149-582
aattggtctgaggtgcacttgggctttgggatgtttcccgacttaattggtctgaagtgcagcctgggctttgggattttcgggtgatctgaattgcagccaaggcgaccttgagtaggtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagac

SEQ ID NO: 137777 - DNA, 913 bp, Homo sapiens
  Payload ID: 6980
  Gene Symbol: GSR
  Gene Name: glutathione reductase
  ENST ID: ENST00000523295
  CDS Start-End: 1-396
cccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagccgcagcgtcattgttggtgcaggttacattgctgtggagatggcagggatcctgtcagccctgggttctaagacatcactgatgatacggcatgataaggtacttagaagttttgattcaatgatcagcaccaactgcacggaggagctggagaacgctggcgtggaggtgctgaagttctcccaggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaa

SEQ ID NO: 137778 - DNA, 1323 bp, Homo sapiens
  Payload ID: 6980
  Gene Symbol: GSR
  Gene Name: glutathione reductase
  Uniprot ID: P00390
  ENST ID: ENST00000537535
  CDS Start-End: 1-1323
atggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagacatcactgatgatacggcatgataaggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttga

SEQ ID NO: 137779 - DNA, 1410 bp, Homo sapiens
  Payload ID: 6980
  Gene Symbol: GSR
  Gene Name: glutathione reductase
  Uniprot ID: P00390
  ENST ID: ENST00000541648
  CDS Start-End: 1-1410
atggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagacatcactgatgatacggcatgataaggtacttagaagttttgattcaatgatcagcaccaactgcacggaggagctggagaacgctggcgtggaggtgctgaagttctcccaggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttga

SEQ ID NO: 137780 - DNA, 1482 bp, Homo sapiens
  Payload ID: 6980
  Gene Symbol: GSR
  Gene Name: glutathione reductase
  Uniprot ID: P00390
  ENST ID: ENST00000546342
  CDS Start-End: 1-1482
atggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagacatcactgatgatacggcatgataaggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttga

SEQ ID NO: 137781 - DNA, 1019 bp, Homo sapiens
  Payload ID: 6981
  Gene Symbol: GSTA1
  Gene Name: glutathione S-transferase alpha 1
  Uniprot ID: P08263
  ENST ID: ENST00000334575
  CDS Start-End: 157-825
gtggcttttccctaacttgactcttctttcagtgggagagaactattgagaggaacaaagagcttataaatacattaggacctggaattcagttgtcgagccaggacggtgacagcgtttaacaaagcttagagaaacctccaggagactgctatcatggcagagaagcccaagctccactacttcaatgcacggggcagaatggagtccacccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagagagccctgattgatatgtatatagaaggtatagcagatttgggtgaaatgatcctccttctgcccgtatgtccacctgaggaaaaagatgccaagcttgccttgatcaaagagaaaataaaaaatcgctacttccctgcctttgaaaaagtcttaaagagccatggacaagactaccttgttggcaacaagctgagccgggctgacattcatctggtggaacttctctactacgtcgaggagcttgactccagtcttatctccagcttccctctgctgaaggccctgaaaaccagaatcagcaacctgcccacagtgaagaagtttctacagcctggcagcccaaggaagcctcccatggatgagaaatctttagaagaagcaaggaagattttcaggttttaataacgcagtcatggaggccaagaacttgcaataccaatgttctaaagttttgcaacaataaagtactttacctaagtgttgattgtgcctgttgtgaagctaatgaactctttcaaattatatgctaattaaataatacaactcctattcgctgacttagttaaaattgatttgttttcattaggatctgatgt

SEQ ID NO: 137782 - DNA, 1313 bp, Homo sapiens
  Payload ID: 6982
  Gene Symbol: GSTA2
  Gene Name: glutathione S-transferase alpha 2
  Uniprot ID: P09210
  ENST ID: ENST00000493422
  CDS Start-End: 157-825
gtggcttttccctaacttgacccttctttcagtgggagggaactattgagaggaacaaagagcttataaatacattaggacctggaattcggttgtccagccacaaaggtgacagcatttaacaaagcttagagaaacctccaggagactgctaccatggcagagaagcccaagctccactactccaatatacggggcagaatggagtccatccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagaaagccctgattgatatgtatatagaaggtatagcagatttgggtgaaatgatccttcttctgccctttagtcaacctgaggaacaagatgccaagcttgccttgatccaagagaaaacaaaaaatcgctacttccctgcctttgaaaaagtcttaaagagccacggacaagactaccttgttggcaacaagctgagccgggctgacattcacctggtggaacttctctactacgtggaagagcttgactctagccttatttccagcttccctctgctgaaggccctgaaaaccagaatcagtaacctgcccacagtgaagaagtttctacagcctggcagcccaaggaagcctcccatggatgagaaatctttagaagaatcaaggaagattttcaggttttaataaaccagccatagaggtcaagaacatgcaagaccagtattctaaagttttgcaacaattaagtgctttacctaagtgttgattgtgcctgttgtgaagctaatgaactctttcaaattatatgctaattaaataatacaactcctattcacccacttagttaaaattgatttcttctcattaggatctgatgtgaattcagttttccaatctcctcctagccaacaattttcttggaattacaaattcagtaaaaatggaaactataaattatgtggtttgtttgacttttccaagaattgccctgtaacatacaatttgtcatacaatctattaaaatgccaatgtaaaaatgcacctctgacattttcaggtatgcacaggagaagagttaccatcctggataatggcataaagacattttcttcttttcctgaacagtcattttatttctgataaaagcattctttctaatgcatttgcaaaac

SEQ ID NO: 137783 - DNA, 902 bp, Homo sapiens
  Payload ID: 6983
  Gene Symbol: GSTA3
  Gene Name: glutathione S-transferase alpha 3
  Uniprot ID: Q16772
  ENST ID: ENST00000211122
  CDS Start-End: 67-735
ggtggccttgagaagctgagcggagaccggctagactttactcaaagaaaccaagagactgttaccatggcagggaagcccaagcttcactacttcaatggacggggcagaatggagcccatccggtggctcttggctgcagctggagtggagtttgaagagaaatttataggatctgcagaagatttgggaaagttaagaaatgatgggagtttgatgttccagcaagtaccaatggttgagattgatgggatgaagttggtacagaccagagccattctcaactacattgccagcaaatacaacctctacgggaaagacataaaggagagagccctaattgatatgtatacagaaggtatggcagatttgaatgaaatgatccttcttctgcccttatgtcgacctgaggaaaaagatgccaagattgccttgatcaaagagaaaacaaaaagtcgctatttccctgccttcgaaaaagtgttacagagccatggacaagactaccttgttggcaacaagctgagccgggctgacattagcctggtggaacttctctactatgtggaagagcttgactccagccttatctccaacttccctctgctgaaggccctgaaaaccagaatcagcaacctgcccacggtgaagaagtttctacagcctggcagcccaaggaagcctcccgcagatgcaaaagctttagaagaagccagaaagattttcaggttttaataaagcagccatggaggctaagaacatgcaagaccaatattctaaagttttgcaacaatgaagtgctttacttaagtgttgattgtgcctgttgtaaagctaatgaaccctttccaattatatgctaattaaataataaaaactcctatttgctaacttagttaaaa

SEQ ID NO: 137784 - DNA, 775 bp, Homo sapiens
  Payload ID: 6983
  Gene Symbol: GSTA3
  Gene Name: glutathione S-transferase alpha 3
  ENST ID: ENST00000370968
  CDS Start-End: 90-608
gcggagaccggctagactttactcaatttgaagagaaatttataggatctgcagaagatttgggaaagttaagaaatgatgggagtttgatgttccagcaagtaccaatggttgagattgatgggatgaagttggtacagaccagagccattctcaactacattgccagcaaatacaacctctacgggaaagacataaaggagagagccctaattgatatgtatacagaaggtatggcagatttgaatgaaatgatccttcttctgcccttatgtcgacctgaggaaaaagatgccaagattgccttgatcaaagagaaaacaaaaagtcgctatttccctgccttcgaaaaagtgttacagagccatggacaagactaccttgttggcaacaagctgagccgggctgacattagcctggtggaacttctctactatgtggaagagcttgactccagccttatctccaacttccctctgctgaaggccctgaaaaccagaatcagcaacctgcccacggtgaagaagtttctacagcctggcagcccaaggaagcctcccgcagatgcaaaagctttagaagaagccagaaagattttcaggttttaataaagcagccatggaggctaagaacatgcaagaccaatattctaaagttttgcaacaatgaagtgctttacttaagtgttgattgtgcctgttgtaaagctaatgaaccctttccaattatatgctaattaaataataaaaactcctatttgctaacttagttaaaa

SEQ ID NO: 137785 - DNA, 411 bp, Homo sapiens
  Payload ID: 6983
  Gene Symbol: GSTA3
  Gene Name: glutathione S-transferase alpha 3
  ENST ID: ENST00000431899
  CDS Start-End: 87-411
cccaagcttcactacttcaatggacggggcagaatggagcccatccggtggctcttggctgcagctggagtggagatgggagtttgatgttccagcaagtaccaatggttgagattgatgggatgaagttggtacagaccagagccattctcaactacattgccagcaaatacaacctctacgggaaagacataaaggagagagccctaattgatatgtatacagaaggtatggcagatttgaatgaaatgatccttcttctgcccttatgtcgacctgaggaaaaagatgccaagattgccttgatcaaagagaaaacaaaaagtcgctatttccctgccttccgggctgacattagcctggtggaacttctctactatgtggaagagcttgactccagccttatctcca

SEQ ID NO: 137786 - DNA, 669 bp, Homo sapiens
  Payload ID: 6983
  Gene Symbol: GSTA3
  Gene Name: glutathione S-transferase alpha 3
  ENST ID: ENST00000616666
  CDS Start-End: 1-669
atggcagggaagcccaagcttcactacttcaatggacggggcagaatggagcccatccggtggctcttggctgcagctggagtggagtttgaagagaaatttataggatctgcagaagatttgggaaagttaagaaatgatgggagtttgatgttccagcaagtaccaatggttgagattgatgggatgaagttggtacagaccagagccattctcaactacattgccagcaaatacaacctctacgggaaagacataaaggagagagccctaattgatatgtatacagaaggtatggcagatttgaatgaaatgatccttcttctgcccttatgtcgacctgaggaaaaagatgccaagattgccttgatcaaagagaaaacaaaaagtcgctatttccctgccttcgaaaaagtgttacagagccatggacaagactaccttgttggcaacaagctgagccgggctgacattagcctggtggaacttctctactatgtggaagagcttgactccagccttatctccaacttccctctgctgaaggccctgaaaaccagaatcagcaacctgcccatggtgaagaaatttctacagcctggcagcccaaggaagtctctcatggatgagaaatctttagaagaagcaaggaagattttcagattttaa

SEQ ID NO: 137787 - DNA, 793 bp, Homo sapiens
  Payload ID: 6984
  Gene Symbol: GSTA4
  Gene Name: glutathione S-transferase alpha 4
  Uniprot ID: O15217
  ENST ID: ENST00000370959
  CDS Start-End: 119-787
ctcactctcgcattcttccctcactcccccagttcagtccttctcttgtcttttcttcctcttgtcctttgtcctcctgctccatccagtctgggcagagaaagcctgaaaagctatcatggcagcaaggcccaagctccactatcccaacggaagaggccggatggagtccgtgagatgggttttagctgccgccggagtcgagtttgatgaagaatttctggaaacaaaagaacagttgtacaagttgcaggatggtaaccacctgctgttccaacaagtgcccatggttgaaattgacgggatgaagttggtacagacccgaagcattctccactacatagcagacaagcacaatctctttggcaagaacctcaaggagagaaccctgattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaac

SEQ ID NO: 137788 - DNA, 859 bp, Homo sapiens
  Payload ID: 6984
  Gene Symbol: GSTA4
  Gene Name: glutathione S-transferase alpha 4
  Uniprot ID: O15217
  ENST ID: ENST00000370960
  CDS Start-End: 255-644
agtgagggaaaatgcagcaacaaaaataaagaacagtttcccgtgccaaaatcctgaatattcatttcgcccctgagcactgggttgaagacgcgaaattgggactgttggtctgcgacgagctgctgcatttgtatttcagaaagcctgaaaagctatcatggcagcaaggcccaagctccactatcccaacggaagaggccggatggagtccgtgagatgggttttagctgccgccggagtcgaggattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaacgagatcatctcttctagaaatatcaaccttttttgtccagtaaataattgttaggggatctttattggaaaacttttt

SEQ ID NO: 137789 - DNA, 1334 bp, Homo sapiens
  Payload ID: 6984
  Gene Symbol: GSTA4
  Gene Name: glutathione S-transferase alpha 4
  Uniprot ID: O15217
  ENST ID: ENST00000370963
  CDS Start-End: 149-817
agtctccattggtgaggtcgtcccggagcctcgcccagctcccgcgcgctagagccgcctgctggtctcacccagccgggaccgctgacctggcgctttgtgcggctccaggcctccgagtggactccagaaagcctgaaaagctatcatggcagcaaggcccaagctccactatcccaacggaagaggccggatggagtccgtgagatgggttttagctgccgccggagtcgagtttgatgaagaatttctggaaacaaaagaacagttgtacaagttgcaggatggtaaccacctgctgttccaacaagtgcccatggttgaaattgacgggatgaagttggtacagacccgaagcattctccactacatagcagacaagcacaatctctttggcaagaacctcaaggagagaaccctgattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaacgagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtattagccaaaataaagaatttatgagtcatt

SEQ ID NO: 137790 - DNA, 379 bp, Homo sapiens
  Payload ID: 6984
  Gene Symbol: GSTA4
  Gene Name: glutathione S-transferase alpha 4
  ENST ID: ENST00000457564
  CDS Start-End: 113-379
aaagcctgaaaagctatcatggcagcaaggcccaagctccactatcccaacggaagaggccggatggagtccgtgagatgggttttagctgccgccggagtcgaggattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccag

SEQ ID NO: 137791 - DNA, 845 bp, Homo sapiens
  Payload ID: 6985
  Gene Symbol: GSTA5
  Gene Name: glutathione S-transferase alpha 5
  Uniprot ID: Q7RTV2
  ENST ID: ENST00000284562
  CDS Start-End: 71-739
agttgcccagccacgacagtgacagagtttaacaaactaagcttagagaaacctccaggagactgctatcatggcagagaagcccaagctccactactccaatgcacggggcagtatggagtccattcggtggctcctggctgcagctggagtagagttggaagagaaatttctagaatctgcagaagatttggacaagttaagaaatgatgggagtttgctgttccagcaagtaccaatggttgagattgacgggatgaagctggtgcagaccagagccattcttaactacattgccagcaaatacaacctttatgggaaagacatgaaggagagagccctgattgatatgtacacagaaggtatagtagatttgactgaaatgatccttcttctgctcatatgtcaaccagaggaaagagatgccaagactgccttggtcaaagagaaaataaaaaatcgctacttccctgcctttgaaaaagtcttaaagagccacagacaagactaccttgttggcaacaagctgagctgggctgacattcacctggtggaacttttctactacgtggaagagcttgactcgagtcttatctccagcttccctctgctgaaggccctgaaaaccagaatcagcaacctgcccacggtgaagaagtttctgcagcctggcagccagagaaagcctcccatggatgagaaatctttagaagaagcaaggaagattttcaggttttaataaagcagctatggaggccaagaacatgccagaccaatattctacagtttgcaacaatgaagtgctttacctaagtgtggattgtgcctcttgtaaagctaataaa

SEQ ID NO: 137792 - DNA, 892 bp, Homo sapiens
  Payload ID: 6985
  Gene Symbol: GSTA5
  Gene Name: glutathione S-transferase alpha 5
  Uniprot ID: Q7RTV2
  ENST ID: ENST00000370989
  CDS Start-End: 31-699
gcttagagaaacctccaggagactgctatcatggcagagaagcccaagctccactactccaatgcacggggcagtatggagtccattcggtggctcctggctgcagctggagtagagttggaagagaaatttctagaatctgcagaagatttggacaagttaagaaatgatgggagtttgctgttccagcaagtaccaatggttgagattgacgggatgaagctggtgcagaccagagccattcttaactacattgccagcaaatacaacctttatgggaaagacatgaaggagagagccctgattgatatgtacacagaaggtatagtagatttgactgaaatgatccttcttctgctcatatgtcaaccagaggaaagagatgccaagactgccttggtcaaagagaaaataaaaaatcgctacttccctgcctttgaaaaagtcttaaagagccacagacaagactaccttgttggcaacaagctgagctgggctgacattcacctggtggaacttttctactacgtggaagagcttgactcgagtcttatctccagcttccctctgctgaaggccctgaaaaccagaatcagcaacctgcccacggtgaagaagtttctgcagcctggcagccagagaaagcctcccatggatgagaaatctttagaagaagcaaggaagattttcaggttttaataaagcagctatggaggccaagaacatgccagaccaatattctacagtttgcaacaatgaagtgctttacctaagtgtggattgtgcctcttgtaaagctaataaactctttccaattacatgctaattaaataataaataactcttatctgtcaacttagctaaaattgatttgttttcattagtatctgat

SEQ ID NO: 137793 - DNA, 669 bp, Homo sapiens
  Payload ID: 6985
  Gene Symbol: GSTA5
  Gene Name: glutathione S-transferase alpha 5
  ENST ID: ENST00000619736
  CDS Start-End: 1-669
atggcagagaagcccaagctccactactccaatgcacagggcagaatggagtccacctggtggctcctggctgcagccggagtagagttggaagagaaatttctagaatctgcagaagatttggacaagttaagaaatgatgggagtttgctgttccagcaagtaccaatggttgagattgacgggatgaagctggtgcagaccagagccattcttaactacattgccagcaaatacaacctttatgggaaagacatgaaggagagagccctgattgatatgtacacagaaggtatagtagatttgactgaaatgatccttcttctgctcatatgtcaaccagaggaaagagatgccaagactgccttggtcaaagagaaaataaaaaatcgctacttccctgcctttgaaaaagtcttaaagagccacagacaagactaccttgttggcaacaagctgagctgggctgacattcacctggtggaacttttctactacgtggaagagcttgactcgagtcttatctccagcttccctctgctgaaggccctgaaaaccagaatcagcaacctgcccacggtgaagaagtttctgcagcctggcagccagagaaagcctcccatggatgagaaatctttagaagaagcaaggaagattttcaggttttaa

SEQ ID NO: 137794 - DNA, 1044 bp, Homo sapiens
  Payload ID: 6986
  Gene Symbol: GSTK1
  Gene Name: glutathione S-transferase kappa 1
  Uniprot ID: Q9Y2Q3
  ENST ID: ENST00000358406
  CDS Start-End: 72-752
aagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaacatttctgtgtctgta

SEQ ID NO: 137795 - DNA, 888 bp, Homo sapiens
  Payload ID: 6986
  Gene Symbol: GSTK1
  Gene Name: glutathione S-transferase kappa 1
  Uniprot ID: Q9Y2Q3
  ENST ID: ENST00000409500
  CDS Start-End: 86-730
ccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaagggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatg

SEQ ID NO: 137796 - DNA, 2219 bp, Homo sapiens
  Payload ID: 6986
  Gene Symbol: GSTK1
  Gene Name: glutathione S-transferase kappa 1
  ENST ID: ENST00000442394
  CDS Start-End: 64-636
cagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagagaaactcccctggtctctctatcagcaacagaaaaccaagccagatggactttgcaactaatcaagtttgggatttactgtcttctgaccaaccacagtgactgagatggggctgggaccagaagcccagtgggagtgaacagccgagggaaccagagtctggctgagcttgtggccagatatttaaactgggtccagccacacctgcaaaaccagggcaaggcagtaccgggaaactggctggagttgctgcggtttggggaagttgcacaccctttcatagatacctcccttaaccctcagtgcagattctgagaaaactccaaggcttctctgcctaacctagtataacccctgttccctactacatacatataacttttccattcccccagtaattgacccaaagtccctgcctctagctgtgcccattgtgcaatgatcagaatcccttgtttcaatagtattttgacttctttaagaatactctgtatttggaagctgaaacctcacttggatccattgttgggaaccaagtacggagccttacatagcccggaggagtttcaggagcaatgccactttcccttccatccctccctctgggtctggctcttcccatagtccattttccccttttatctcccattaatttctgtcttcctctctcaccttttccatgtctctagcatcctccaggatttaaaatcatctttacccaacttatctgtgaagtaatggcaaaagaacatctccaaattaagtactccttttcttcaaaggagtttcatgggatgtacagctagtataaaataaaaatatgggaagatgtccaatcttaaaaaccataagggcaaattaagacaaaactaagctgcccagagcagggtgagtggaaccagttttatgaataaagatgcttgtctcagcactatatgtggatatcaaaaattgtgaacaacttgaacacctatcaggaggagaatactttaatcaattatggcacattcaggagataatgttttacagtcatcaaaaattgtatatgagggccagcacggtggctcacacctgtaatcccagcactttgggaggccaaggcaggcggatcacctgaggtcaggagttcgagaccagactggctaacatggtaaaaccctgtttctactaaaaatacaaaaaagtaaccgggtgtggtggcacgtgcctgtaatcccagctactcgggaggctgaggcaggagaatcgcttgaacccgggaggcagaggttgtggtgagctgagattgcactattgcactccagcttgggcaacaagagcgaaactctgtctcaaaaaaaaattgtatttctgaagaattgttaagaacattggaaattcttgagatataatattgattggaaaaagatgaaactatatggtatgatctcaatatgtcctgatgaataaaaacataatacagag

SEQ ID NO: 137797 - DNA, 556 bp, Homo sapiens
  Payload ID: 6986
  Gene Symbol: GSTK1
  Gene Name: glutathione S-transferase kappa 1
  ENST ID: ENST00000436038
  CDS Start-End: 203-556
taggtttgttcatgtttctcacagaaaggacgtgaaaatgaaaatacttgagtggcctgagatttgcctagggaatcatcttagaagcaaagaaggaaaagaacatcacggaaattcccgcaggcataattccatggacagaactagacaacgtattctctagcagttttgaaaccaagatcagctcgtcccatgctcaggaatgaccaagggcagtttggaggttaaaggcacgatggagttgatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaagg

SEQ ID NO: 137798 - DNA, 850 bp, Homo sapiens
  Payload ID: 6986
  Gene Symbol: GSTK1
  Gene Name: glutathione S-transferase kappa 1
  Uniprot ID: Q9Y2Q3
  ENST ID: ENST00000443571
  CDS Start-End: 74-625
agaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcaga

SEQ ID NO: 137799 - DNA, 1185 bp, Homo sapiens
  Payload ID: 6986
  Gene Symbol: GSTK1
  Gene Name: glutathione S-transferase kappa 1
  Uniprot ID: Q9Y2Q3
  ENST ID: ENST00000479303
  CDS Start-End: 59-907
tctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaagggtgagtgtggggctctgggaatcctctgggaggaccttggatgactttctgaccttccccaggcacgttttcagggtcatgatcctgcccccgcccgggggatctactgtcctcccagtcacacccctctccccgcaccgccttcctgctgtcttctcttcttcccagaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaaca

SEQ ID NO: 137800 - DNA, 1028 bp, Homo sapiens
  Payload ID: 6987
  Gene Symbol: GSTM1
  Gene Name: glutathione S-transferase mu 1
  Uniprot ID: P09488
  ENST ID: ENST00000349334
  CDS Start-End: 35-580
aggcctgtctgcggaatccgcaccaaccagcaccatgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaacca

SEQ ID NO: 137801 - DNA, 1161 bp, Homo sapiens
  Payload ID: 6987
  Gene Symbol: GSTM1
  Gene Name: glutathione S-transferase mu 1
  Uniprot ID: P09488
  ENST ID: ENST00000309851
  CDS Start-End: 55-711
ctctgagccctgctcggtttaggcctgtctgcggaatccgcaccaaccagcaccatgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccaca

SEQ ID NO: 137802 - DNA, 790 bp, Homo sapiens
  Payload ID: 6987
  Gene Symbol: GSTM1
  Gene Name: glutathione S-transferase mu 1
  ENST ID: ENST00000369819
  CDS Start-End: 17-466
cgcaccaaccagcaccatgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcct

SEQ ID NO: 137803 - DNA, 852 bp, Homo sapiens
  Payload ID: 6987
  Gene Symbol: GSTM1
  Gene Name: glutathione S-transferase mu 1
  ENST ID: ENST00000369823
  CDS Start-End: 46-759
ctgctcggtttaggcctgtctgcggaatccgcaccaaccagcaccatgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatgggatgctggggagcctggtggcccaactgagcttcgccggtttcccatccatccagctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctg

SEQ ID NO: 137804 - DNA, 512 bp, Homo sapiens
  Payload ID: 6987
  Gene Symbol: GSTM1
  Gene Name: glutathione S-transferase mu 1
  ENST ID: ENST00000483399
  CDS Start-End: 30-287
tgtctgcggaatccgcaccaaccagcaccatgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatgtggggagacagaagaggagaagattcgtgtggacattttggagaaccagaccatggacaaccatatgcagctgggcatgatctgctacaatccagaatttgaaaagtgtaatgttggttggagctcgagaaggaatctggatactgtgtgccggaccagccaaagaatcctgtgtcaaaaccgagagaacgaataagccttcatcaccatggcacatttatataaaaagaaagggagagatgttgcgggaagtcagggaccccgaatggagggactgactggagccgcggcagaggaacataaat

SEQ ID NO: 137805 - DNA, 491 bp, Homo sapiens
  Payload ID: 6987
  Gene Symbol: GSTM1
  Gene Name: glutathione S-transferase mu 1
  ENST ID: ENST00000476065
  CDS Start-End: 185-491
tgtctgcggaatccgcaccaaccagcaccatgcccatgatactggggtactgggacatccgcgggacaaagtcagggaccctccatctctgacgcgacctgcgggccatctctcccagctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagc

SEQ ID NO: 137806 - DNA, 1157 bp, Homo sapiens
  Payload ID: 6988
  Gene Symbol: GSTM2
  Gene Name: glutathione S-transferase mu 2 (muscle)
  Uniprot ID: P28161
  ENST ID: ENST00000241337
  CDS Start-End: 51-707
gagccccgccccgctgaggcctgtctgcagaatccacagcaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccaca

SEQ ID NO: 137807 - DNA, 1073 bp, Homo sapiens
  Payload ID: 6988
  Gene Symbol: GSTM2
  Gene Name: glutathione S-transferase mu 2 (muscle)
  ENST ID: ENST00000369827
  CDS Start-End: 81-626
tctaccctctctgggcctctcacaaacgctgagccccgccccgctgaggcctgtctgcagaatccacagcaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgagaaactgaaaccagaatacctgcaggcactccctgaaatgctgaagctctactcacagtttctggggaagcagccatggtttcttggggacaagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaacc

SEQ ID NO: 137808 - DNA, 914 bp, Homo sapiens
  Payload ID: 6988
  Gene Symbol: GSTM2
  Gene Name: glutathione S-transferase mu 2 (muscle)
  ENST ID: ENST00000369829
  CDS Start-End: 25-606
gcagaatccacagcaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgaggtgttccccctgtgagatgagtagcacgctgattttactcctgttcactgaccttctcctctgcatgaggcagggtgtgaggcacagtgggagatgcatagatgacagccccatcctggaaatgagtgcagtgagaggcctgcaggcagagcagcctgtgaagtgtgtgctgaacttgtttgagagcagcaaatcctacattactacagatttggggatttgaggcatttgtccaacaggcttctgagccttgaatctgtttcccttttccactccccatcaagagatctgcttgctcagctagttcccatcagctctggttc

SEQ ID NO: 137809 - DNA, 1730 bp, Homo sapiens
  Payload ID: 6988
  Gene Symbol: GSTM2
  Gene Name: glutathione S-transferase mu 2 (muscle)
  ENST ID: ENST00000369831
  CDS Start-End: 95-757
agcaaggcttcccctctaccctctctgggcctctcacaaacgctgagccccgccccgctgaggcctgtctgcagaatccacagcaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgaggaaaagtgtaatgttggttggagctcgagaaggaatctggatactgtgtgccggaccagccaaagaatcctgtgtcaaaaccgagagaacgaataagccttcatcaccatggcacatttatataaaaagaaagggagagatgttgcgggaagtcagggaccccgaatggagggactgactggagccgcggcagaggaacataaattgcaaatatttcattttaatatggacatttatcagttcccaaattattactttttacatttcttacgcctgtcttactttaatctcttaatcctgttatcttcataagctgaggatatatgtcacctcaggaccactgtgataattgtgttaactgtacaaattgattgtaaaacatgtgtgtttgcacaatatgaaatcagtgcaccttgaagaagaacagaataacagtgatttttaggcaacaagagaagacaaccataaggtctgactgcgtgcagggtcaggcaaaatagagccatatttttcttcttgcagggagcctataaatggacatggaagtagggaagatattgctaaattcttttcctagcaaggaatattactattaatactctgggaaaggaatgcattcctggggggaggtctataaacggccgctctgggaatgtctgtcctatgcagttgagacaaggactgaagtacaccctggtctcctgcagtaccctcaggcttactagggtggggaaaaacctggccctggcaaatctgtggtcagactggttctctgctcttgaaccctgtgttctgttgtttaagatgtttatcaagacaatacgtgcactgctgaacatagacccttatcaggagttctacttttgcccttgtcctgtttcctcagaagcatgtgatctctgttctgttttttgccccttaaagcatgtgatctttgtacctaccccccgttcgtacaccccctccccttttgcaatccttaataaaagcttgctggttttgaggctcgggccggcatcacggtcctactgatatgtgatgtcacccctggcggcccagctgtaaaatt

SEQ ID NO: 137810 - DNA, 982 bp, Homo sapiens
  Payload ID: 6988
  Gene Symbol: GSTM2
  Gene Name: glutathione S-transferase mu 2 (muscle)
  ENST ID: ENST00000414179
  CDS Start-End: 324-587
gtctgcagaatccacagcaaccagcaccatgcccatgacactggggtactggaacatccgcgggctggcccattccatccgcctgctcctggaatacacagactcaagctacgaggaaaagaactcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgagcattcctgatgtttggattcaggctgcttccctcatccctgctgctcctgatccccgtccacagacccactttccccgctggtgtgatccttgtggccactatggcagctactttggagagccgctagtccagtccttcccgccttccgcagagctctactcctgcttctgaagaagccacctggggcctggccttcttcctggctcctcagagtccttgcaacagcaggcactacttctctctcctgcactcaacccctctcccactccactgcctctcagtgtgccaaaacacgaagatgtgtcctgattttcaaaatctctcccctgaagttcccacctgatatgtagttggagatgggcaaatacagcgtccttgaagcatcattttattcatagtgcct

SEQ ID NO: 137811 - DNA, 1478 bp, Homo sapiens
  Payload ID: 6988
  Gene Symbol: GSTM2
  Gene Name: glutathione S-transferase mu 2 (muscle)
  Uniprot ID: P28161
  ENST ID: ENST00000442650
  CDS Start-End: 95-670
agcaaggcttcccctctaccctctctgggcctctcacaaacgctgagccccgccccgctgaggcctgtctgcagaatccacagcaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgagcattcctgatgtttggattcaggctgcttccctcatccctgctgctcctgatccccgtccacagacccactttccccgctggtgtgatccttgtggccactatggcagctactttggagagccgctagtccagtccttcccgccttccgcagagctctactcctgcttctgaagaagccacctggggcctggccttcttcctggctcctcagagtccttgcaacagcaggcactacttctctctcctgcactcaacccctctcccactccactgcctctcagtgtgccaaaacacgaagatgtgtcctgattttcaaaatctctcccctgaagttcccacctgatatgtagttggagatgggcaaatacagcgtccttgaagcatcattttattcatagtgcctggaatgtagtaggatctcgacaattgttgtttcaataaaggaatgaccaaatatattaatactgtaaaaagtaaagtagaggttcctcttcaaagagacttttctccccatctaattaagaataagtcgtaacttctcttagaagcaaaatttattcaaagaccggtgctgatattctgaaatatctgctagctgtaataaagaaattaatgtactttatgttcttaactcccacaatttagcctaaatacttgccctggcatgcttatactgatccaaacaagcatgaggtcatagcctgttcctcttccttatttgaaggtgtttttaccttactcagcattccacaagtgagttcccccttcctttgttctcctctgcctctgcctcttttaaaaagttctaagttgcta

SEQ ID NO: 137812 - DNA, 476 bp, Homo sapiens
  Payload ID: 6988
  Gene Symbol: GSTM2
  Gene Name: glutathione S-transferase mu 2 (muscle)
  ENST ID: ENST00000467579
  CDS Start-End: 34-476
ggcctgtctgcagaatccacagcaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgcactccctgaaatgctgaagctctactcacagtttctggggaagcagccatggtttcttggggacaagatcacctttgtgga

SEQ ID NO: 137813 - DNA, 1449 bp, Homo sapiens
  Payload ID: 6988
  Gene Symbol: GSTM2
  Gene Name: glutathione S-transferase mu 2 (muscle)
  Uniprot ID: P28161
  ENST ID: ENST00000460717
  CDS Start-End: 66-641
cctctcacaaacgctgagccccgccccgctgaggcctgtctgcagaatccacagcaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgagcattcctgatgtttggattcaggctgcttccctcatccctgctgctcctgatccccgtccacagacccactttccccgctggtgtgatccttgtggccactatggcagctactttggagagccgctagtccagtccttcccgccttccgcagagctctactcctgcttctgaagaagccacctggggcctggccttcttcctggctcctcagagtccttgcaacagcaggcactacttctctctcctgcactcaacccctctcccactccactgcctctcagtgtgccaaaacacgaagatgtgtcctgattttcaaaatctctcccctgaagttcccacctgatatgtagttggagatgggcaaatacagcgtccttgaagcatcattttattcatagtgcctggaatgtagtaggatctcgacaattgttgtttcaataaaggaatgaccaaatatattaatactgtaaaaagtaaagtagaggttcctcttcaaagagacttttctccccatctaattaagaataagtcgtaacttctcttagaagcaaaatttattcaaagaccggtgctgatattctgaaatatctgctagctgtaataaagaaattaatgtactttatgttcttaactcccacaatttagcctaaatacttgccctggcatgcttatactgatccaaacaagcatgaggtcatagcctgttcctcttccttatttgaaggtgtttttacctttctcagcgttccacaagtgagttcccccttcctttgttctcctctgcctctgcctcttttaaaaagttctaagttgcta

SEQ ID NO: 137814 - DNA, 4046 bp, Homo sapiens
  Payload ID: 6989
  Gene Symbol: GSTM3
  Gene Name: glutathione S-transferase mu 3 (brain)
  Uniprot ID: P21266
  ENST ID: ENST00000256594
  CDS Start-End: 230-907
tgcagcactcctgcccgggtcccgcctcggggtcgccaggccctgaaccccaacgccggcattagtcgcgcctgcgcacggccctgtggagccgcggaggcaagggacggagaacggggcggaggcggagtcagggcgcccgcgcgtgggccccgcccccttatgtcgggtataaagcccctcccgctcacagtttccctagtcctcgaaggctcggaagcccgtcaccatgtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctggggaaattctcatggtttgccggggaaaagctcacctttgtggattttctcacctatgatatcttggatcagaaccgtatatttgaccccaagtgcctggatgagttcccaaacctgaaggctttcatgtgccgttttgaggctttggagaaaatcgctgcctacttacagtctgatcagttctgcaagatgcccatcaacaacaagatggcccagtggggcaacaagcctgtatgctgagcaggaggcagacttgcagagcttgttttgtttcatcctgtccgtaaggggtcagcgctcttgctttgctcttttcaatgaatagcacttatgttactggtgtccagctgagtttctcttgggtataaaggctaaaagggaaaaaggatatgtggagaatcatcaagatatgaattgaatcgctgcgatactggcatttccctactccccaactgagttcaagggctgtaggttcatgcccaagccctgagagtgggtactagaaaaaacgagattgcacagttggagagagcaggtgtgttaaatgggactggagtccctgtgaagactgggtgaggataacacaagtaaaactgtggtactgatggacttaaccggagttcggaaaccgtcctgtgtacacatgggagtttagtgtgataaaggcagtatttcagactggtgggctagccaatagagttgggacaattgcttactcattaaaaataatagagccccacttgacactattcactaaaattaatctggaatttaaggcccaacattaaacacaaagctgttgaaatattgatgaaaatgtaagaatttttgtgaccacggggtaggagaagtttctttaaagacgtaaaaagaaaaaaaccataggctgctctgcctgtggagtagccattctttattcttttactttttaaaataataacaatcacaaaggaaagatttgccaattgaataggatcaaattctacaacttttcctaaggcacccacaaataaatgacaagtgagacaaaaagcactagtataaagattatataaagacctataaatcattaagacaactgagtttttaaaaatggacaaaatccatgaacaatttataaaatagaaatatagccaaaaatgtctaaaagatgtttatgatgtaaggaattatcaattacaacagtgagaaaccatatttccttctatccgatgagtaaaaagtttctaaagtgttggcaaggcttaggaaagtgatatgcatttcctgctggtcaagttgtaaattagtatagctactttggaggacaattgtaaaatttaaatcatatcctatgacccagcaattccatgctataaaaactcatccatggccgggcttggtggctcacgcctgtaatcccagcactttgggaggctgaggtgggcagatcacgaggtcaagagatcgagaccatcctggccaacatgatgaaaccccgtttctactaaaaatacaaaaattagctgggcatggtggcatgtgcctatagtcccagctactcaggaggctgaggcaggagaattgcttgaacctgggaggcagaggttgcagtgagccgagatcacgccactgcactccagcctggctacagggcgagactctgtctcaaaaaaaaaaaaaaaaaaaaaaaaaaaacattcaaagagacatatactaagatgttcactgtggcattgtctgtaatgacaaataagtggaaaccgtgtaaatacctgtcaatactatggagtaccatgtggcaacggaagaatgagactgaactgtgtgaactaacatgcaaagatccccaaaacaggccaggtgtggttgctcacagctgtaataacaacaccttcagaggctgaggtgagaggatcagttgaggccaggagtttaagaccagcctgggcaacatagtgagacccctgtctcccaaaaattttttttaattagctgtgcgcaattgctcatgcatagtcccagctacccaggaggctgaggtgggaggatcacttgagcccaggaatttgaagctgcagtgagctgtgttcttgccactgcactccaatctgggtgactgagcaagaccctgtctcttaaaaaaataaaaaagatctccaagcatagagaagagtctggagggaaacaccaaactcataacagtcttactgcaggcaagtgggataaaggcccagactccatggtggaagttaaagggcatttccaagttaaggctaagacttgcttttctaactaagagaatgtgctcatgcattgcttgtgtagtagaaactagtttttagaaaagaaagcaaacttaagaaacactgactcctgtggagatgacttggcaccactctcctttcacagagcagagtctgaatagtcttcagagataggcctgtgggccagattgccatcccctatggaccagaagccaaggatctctctagtgatggtcagagggcccaaatggcagggatacccagtgatgtcaggaggaatagtacagacagaaggtgctaagcagacaattcaactgccatgttttgccaccccctgtgagcagggattaggtgttcaggccagtatcttgggcatgggggagcctttggccagaagaggtataaagctcagaagtttttcagtctgataactattgatataatttccatagtgtgagggagcggtatgctctacccttgtgtatttaaggcaggacagagaaattgaggatgcccctggggctagatcgatgatatgaccagaaatcaaaaagggaatgcattatttattgctgtgtaacactgttaagagaggaggtagttaagggatggataggcacatagagagggaaggtctcaggagaagggatagaaaggaactatgttcacaagaacaacggcaagacagtgcctatactgcctctacagttaataggaaaaacggaagaagttacccttaagctaggatgttgctcagaagtgaccatcccaactttggtgcgggcacaataaatcagcctaaatgtccctaatttaacccagctcattataatgtcattaaacatgacattagcattgtggttttagcacccccatgggttttgcttaggcactcatgggtaataaccaagatggagtccctttggcaaaacttaggcatgcacagctgtagtaccccaagaagaaaatgttacttctctcatctgggcaaaacccacagaagacttcccagcttctgccacataaaagacacagaacacagacgccttactggcaacctgctttcaagacccctgtctttgctgagagctttcctttttcccaataaattctactctgccctactcactctc

SEQ ID NO: 137815 - DNA, 1565 bp, Homo sapiens
  Payload ID: 6989
  Gene Symbol: GSTM3
  Gene Name: glutathione S-transferase mu 3 (brain)
  Uniprot ID: P21266
  ENST ID: ENST00000361066
  CDS Start-End: 311-988
ggttggttctgagaaggcttcaaggaataggcagacatttcagcaaggctgctgaggaaggataggctgtggaaattaggatgcagcactcctgcccgggtcccgcctcggggtcgccaggccctgaaccccaacgccggcattagtcgcgcctgcgcacggccctgtggagccgcggaggcaagggacggagaacggggcggaggcggagtcagggcgcccgcgcgtgggccccgcccccttatgtcgggtataaagcccctcccgctcacagtttccctagtcctcgaaggctcggaagcccgtcaccatgtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctggggaaattctcatggtttgccggggaaaagctcacctttgtggattttctcacctatgatatcttggatcagaaccgtatatttgaccccaagtgcctggatgagttcccaaacctgaaggctttcatgtgccgttttgaggctttggagaaaatcgctgcctacttacagtctgatcagttctgcaagatgcccatcaacaacaagatggcccagtggggcaacaagcctgtatgctgagcaggaggcagacttgcagagcttgttttgtttcatcctgtccgtaaggggtcagcgctcttgctttgctcttttcaatgaatagcacttatgttactggtgtccagctgagtttctcttgggtataaaggctaaaagggaaaaaggatatgtggagaatcatcaagatatgaattgaatcgctgcgatactggcatttccctactccccaactgagttcaagggctgtaggttcatgcccaagccctgagagtgggtactagaaaaaacgagattgcacagttggagagagcaggtgtgttaaatgggactggagtccctgtgaagactgggtgaggataacacaagtaaaactgtggtactgatggacttaaccggagttcggaaaccgtcctgtgtacacatgggagtttagtgtgataaaggcagtatttcagactggtgggctagccaatagagttgggacaattgcttactcattaaaaataatagagccccacttgacactattcactaaaattaatctggaatttaaggcccaacattaaacacaaagctgttgaaatattgatgaaaa

SEQ ID NO: 137816 - DNA, 678 bp, Homo sapiens
  Payload ID: 6989
  Gene Symbol: GSTM3
  Gene Name: glutathione S-transferase mu 3 (brain)
  ENST ID: ENST00000540225
  CDS Start-End: 18-656
ctcggaagcccgtcaccatgtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctggggaaattctcatggtttgccggggaaaagctcacctttgtggattttctcacctatgatatcttggatcagaaccgtatatttgaccccaagtgcctggatgagttcccaaacctgaaggctttcatgtgccgttttggtgacgttctgcactttctctataaaacactcacagctcccctgggacctgcagatccatagtggaggattcttccccggcttt

SEQ ID NO: 137817 - DNA, 1321 bp, Homo sapiens
  Payload ID: 6990
  Gene Symbol: GSTM4
  Gene Name: glutathione S-transferase mu 4
  Uniprot ID: Q03013
  ENST ID: ENST00000326729
  CDS Start-End: 269-856
ctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatctgccctacttgattgatggggctcacaagatcacccagagcaacgccatcctgtgctacattgcccgcaagcacaacctgtgtggggagacagaagaggagaagattcgtgtggacattttggagaaccaggctatggacgtctccaatcagctggccagagtctgctacagccctgactttgagaaactgaagccagaatacttggaggaacttcctacaatgatgcagcacttctcacagttcctggggaagaggccatggtttgttggagacaagatcacctttgtagatttcctcgcctatgatgtccttgacctccaccgtatatttgagcccaactgcttggacgcctttccaaatctgaaggacttcatctcccgctttgaggtttcctgtggcataatgtgatggtcaattttctgcatcaacttgactgggctaagggatgctcagatggcaggtaaaatcattgtgcttgtgagggtgtttccagaagagatttgcctttgaatcagaagacagcaaagatttccttcagcaatgaaggaggcatccaccaaactgtcagggcccagagagaagaaaaagacaggaagggtgaatttgacctctctgactgggacatccatctctgcctatcctgggacctccacactcctggttctctggccttcagacttgatcagggactaacaccatcgcctcccacccccacctttgttctgaggcctttagcctctgaatgataccactggctttcctgcttctctatcctgcagtcggcagatcatgggacttcttcactccaaaattgtgtgagccaattcccataacagatagataaatttataaataaacacacaaatttcctac

SEQ ID NO: 137818 - DNA, 657 bp, Homo sapiens
  Payload ID: 6990
  Gene Symbol: GSTM4
  Gene Name: glutathione S-transferase mu 4
  ENST ID: ENST00000336075
  CDS Start-End: 1-657
atgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatctgccctacttgattgatggggctcacaagatcacccagagcaacgccatcctgtgctacattgcccgcaagcacaacctgtgtggggagacagaagaggagaagattcgtgtggacattttggagaaccaggctatggacgtctccaatcagctggccagagtctgctacagccctgactttgagaaactgaagccagaatacttggaggaacttcctacaatgatgcagcacttctcacagttcctggggaagaggccatggtttgttggagacaagatcacctttgtagatttcctcgcctatgatgtccttgacctccaccgtatatttgagcccaactgcttggacgcctttccaaatctgaaggacttcatctcccgctttgagggcttggagaagatctctgcctacatgaagtccagccgcttcctcccaagacctgtgttcacaaagatggctgtctggggcaacaagtag

SEQ ID NO: 137819 - DNA, 3990 bp, Homo sapiens
  Payload ID: 6990
  Gene Symbol: GSTM4
  Gene Name: glutathione S-transferase mu 4
  ENST ID: ENST00000369833
  CDS Start-End: 915-1523
gtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacggtaatgacacccttgtgtccgggctctgcccactcacgctgagttggcaccaagcaacccatggtggccacctgtggctacctctgcaggcctcccctgctggagctgcaggctgtcccttccctgagccccggtgagggagtcctgtggccttgcaaggcagaatgctggggcgggatgctgggccccctgtttaattgggttgggtgtccctcagagcttccctaaaccctggaagccttagccgtgtggggtccagagccctcagcgggattctttgtccctgaaccctgggatgtgggactgagtggtcagattctagatccacctgtctcagggatcttgccactggttccttgggagggtccccgggaaggagggctgggctctggggaggtttgttttcacttcttcttccccacggcagctcctgactatgacagaagccagtggctgaatgaaaaattcaagctgggcctggactttcccaatgtaggtgcaggggaaggggcggttttgggggaaagtgcgacgtgtctctgactgcatctcctctccccagattagaggtgttcggatcaggagtcttctgcccaattcctctcactcctggttgtctacacagcccctgcatgatgttctgtgtcccagctcatttgttcatgtgacagtatttctatgtcaggcctgccatgagcgggcacagtgagtgcctggtctcccctctgcccttgcatatgggaaggggatgctggggagcctgctggcccaactgagcttccccggtttcccatctatccagctgccctacttgattgatggggctcacaagatcacccagagcaacgccatcctgtgctacattgcccgcaagcacaacctgtgtggggagacagaagaggagaagattcgtgtggacattttggagaaccaggctatggacgtctccaatcagctggccagagtctgctacagccctgactttgagaaactgaagccagaatacttggaggaacttcctacaatgatgcagcacttctcacagttcctggggaagaggccatggtttgttggagacaagatcacctttgtagatttcctcgcctatgatgtccttgacctccaccgtatatttgagcccaactgcttggacgcctttccaaatctgaaggacttcatctcccgctttgaggtgatgcccccatcctcctttctctttgatgccccttgttccgttacctcctttcagatgctttcccagtcctggagctacataaagaataacttgcatttattgagtgctggcttcatgccaggaaccttgcccagcacattatacctatcgtgtggaatttgaaatttccaacattcctacagggtgacagaattatcttgcccatttagagataagaaaactttgaatgagagggtcagtcctttgttctgggtcccagagccagtggaggctgtgctgggctccctgtgagcatctggatctatgggtggcagtcagggctctcccttttgtgacaaaagaaagaagcctcaggcctcatccagcctggatttcacagcccagggcactttggaagaggcagagaactttaggagcatggatgcagctggcaatagtaggactgacacacggtggcattgacgtcgagtacgaaacccacaggcagtattcatagctactcccagaagctttgcacgatcagacccccacgtggggaatcctgagagccagagctgtggccagagctggattagggtacatatgtgggtgcccctgttgaaggagtgtatgttgaagtgctctgtgctggggcactctccttctttatcttttttcctctcttttttccctccagtgttccaagtgttccccctgtgagatgagtagcacactgattttactgctattcaccgaccttctcctctgcatgaggcagggtgtgaggcacagtgggagttgcatagatgactgccccatcctggaaatgagtgcagtgagaggcctgcaggcagagcagcctgtgaggtgtgtggcaccacctgggtaccaggcctggggcctgcccctcactcatggggaaccatccctcacccgtgctgaatttgtttgagagcagcaaatcctacttttagtacagatgtgagaatttgaggcattagtccaacaagtttttcagcctagaatttgttttcctttcccactacccatcaagggatctggttactcagctagttcccatcagctctggctgtggtctcggctgagtggccttggggttatgtaagaggtagtgggaggggaagagagctgagggctgcagcatatggtccacctgggcttggccctttgggaataggcagccctggctctctctgaatccttagaaattacacggctatttgatcctggaaagatcgtgcagagcacacctgagtgtcatacagcctggtctgaggtagtggggttggagatgaggtgggttggggcacagtggtgtttagctcaggtaccaggtggggaggtttagactttctgctttaaaaggaatgattagagcctggtctggcgtttcttttgctggtccaacacaccttgaccactttcatccaggttttgccaggtccttgggtgagatctgggctctcttccaggctgcacagacattttcagaggtcccctctgtgtgtgcaaacctaggcaagccaggtgcctccctgtgaaacaggagaatgttgtgtagtcagagagtgacaggacctcctgagggatttgggggaggatggggatttgacagaaagaggccagaactggagagagacagaaccagtctacgttgcagctctgtcccccttagtagctatttgagtgtgaggaagttactgaacttctgtttcccacatgagaaatggtgataatagattcagccttgcagagtagtcgagtgggttttctaagcttatgttgtaatttctcttgggtacagagcacccagcaccgggtagaatcttcataagtgttagctgttactgtggtacaacattacttaaaggaagttggaagagttaactccgcaaatctggggaccctaagaggctgtgtgatgcctcagcacttgagcccacgtggaaaggctgtggccagggccctgacctgctgtgtctgcagtggggttgtcccagccctcatgggcagctgaccttgagttctggccttattttcccccctctcagggcttggagaagatctctgcctacatgaagtccagccgcttcctcccaaaacctctgtacacaagggtggctgtctggggcaacaagtaatgccttgaaggccaggaggtgggagtgaggagcccatactcagcctgctgcccaggctgtgcagcgcagctggactctgcatcccagcacctgcctcctcgttcctttctcctgtttattcccatctttacccccaagactttattgggcctcttcacttcccctaaacccctgtcccatgcaggccctttgaagcctcagctacccactttccttcatgaacatccccctcccaacactacccttccctgcactaaagccagcctgaccttccttcctgttagtggttgtatctgctttgaagggcctacctggcccctcgcctgtggagctcagccctgagctgtccccgtgttgcatgacagcattgactggtttacaggccctgctcctgcagcatggcccctgccttaggcctacctgatcaaaataaagcctcagccacatttgctatagtcttgtcttatttgctcctggctgcccagact

SEQ ID NO: 137820 - DNA, 1412 bp, Homo sapiens
  Payload ID: 6990
  Gene Symbol: GSTM4
  Gene Name: glutathione S-transferase mu 4
  Uniprot ID: Q03013
  ENST ID: ENST00000369836
  CDS Start-End: 310-966
ggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatctgccctacttgattgatggggctcacaagatcacccagagcaacgccatcctgtgctacattgcccgcaagcacaacctgtgtggggagacagaagaggagaagattcgtgtggacattttggagaaccaggctatggacgtctccaatcagctggccagagtctgctacagccctgactttgagaaactgaagccagaatacttggaggaacttcctacaatgatgcagcacttctcacagttcctggggaagaggccatggtttgttggagacaagatcacctttgtagatttcctcgcctatgatgtccttgacctccaccgtatatttgagcccaactgcttggacgcctttccaaatctgaaggacttcatctcccgctttgagggcttggagaagatctctgcctacatgaagtccagccgcttcctcccaaaacctctgtacacaagggtggctgtctggggcaacaagtaatgccttgaaggccaggaggtgggagtgaggagcccatactcagcctgctgcccaggctgtgcagcgcagctggactctgcatcccagcacctgcctcctcgttcctttctcctgtttattcccatctttacccccaagactttattgggcctcttcacttcccctaaacccctgtcccatgcaggccctttgaagcctcagctacccactttccttcatgaacatccccctcccaacactacccttccctgcactaaagccagcctgaccttccttcctgttagtggttgtatctgctttgaagggcctacctggcccctcgcctgtggagctcagccctgagctgtccccgtgttgcatgacagcattgactggtttacaggccctgctcctgcagcatggcccctgccttaggcctacctgatcaaaataaagcctcagccaca

SEQ ID NO: 137821 - DNA, 1555 bp, Homo sapiens
  Payload ID: 6991
  Gene Symbol: GSTM5
  Gene Name: glutathione S-transferase mu 5
  Uniprot ID: P46439
  ENST ID: ENST00000256593
  CDS Start-End: 59-715
caaagtctgagccccgctccgctgatgcctgtctgcagaatccgcaccaaccagcaccatgcccatgactctggggtactgggacatccgtgggctggcccacgccatccgcttgctcctggaatacacagactcaagctatgtggaaaagaagtacacgctgggggacgctcctgactatgacagaagccagtggctgaatgaaaaattcaagctgggcctggactttcccaatctgccctacttgattgatggggctcacaagatcacccagagcaatgccatcctgcgctacattgcccgcaagcacaacctgtgtggggagacagaagaggagaagattcgtgtggacattttggagaaccaggttatggataaccacatggagctggtcagactgtgctatgacccagattttgagaaactgaagccaaaatacttggaggaactccctgaaaagctaaagctctactcagagtttctggggaagcggccatggtttgcaggagacaagatcacctttgtggatttccttgcctatgatgtccttgacatgaagcgtatatttgagcccaagtgcttggacgccttcctaaacttgaaggacttcatctcccgctttgagggtttgaagaagatctctgcctacatgaagtccagccaattcctccgaggtcttttgtttggaaagtcagctacatggaacagcaaatagggcccagtgatgccagaagatgggagggaggagccaaccttgctgcctgcgaccctggaggacagcctgactccctggacctgccttcttcctttttccttctttctactctcttctcttccccaaggcctcattggcttcctttcttctaacatcatccctccccgcatcgaggctctttaaagcttcagctccccactgtcctccatcaaagtccccctcctaacgtcttcctttccctgcactaacgccaacctgactgcttttcctgtcagtgcttttctcttctttgagaagccagactgatctctgagctccctagcactgtcctcaaagaccatctgtatgccctgctccctttgctgggtccctaccccagctccgtgtgatgcccagtaaagcctgaaccatgcctgccatgtcttgtcttattccctgaggctcccttgactcaggactgtgctcgaattgtgggtggttttttgtcttctgttgtccacagccagagcttagtggatgggtgtgtgtgtgtgtgtgttgggggtggtgatcaggcaggttcataaatttccttggtcatttctgccctctagccacatccctctgttcctcactgtggggattactacagaaaggtgctctgtgccaagttcctcactcattcgcgctcctgtaggccgtctagaactggcatggttcaaagaggggctaggctgatggggaagggggctgagcagctcccaggcagactgccttctttcaccctgtcctgatagacttccctgatctagatatccttcgtcatgacacttctcaataaaacgtatcccaccgtattgt

SEQ ID NO: 137822 - DNA, 657 bp, Homo sapiens
  Payload ID: 6991
  Gene Symbol: GSTM5
  Gene Name: glutathione S-transferase mu 5
  ENST ID: ENST00000369812
  CDS Start-End: 1-657
atgcccatgactctggggtactgggacatccgtgggctggcccacgccatccgcttgctcctggaatacacagactcaagctatgtggaaaagaagtacacgctgggggacgctcctgactatgacagaagccagtggctgaatgaaaaattcaagctgggcctggactttcccaatctgccctacttgattgatggggctcacaagatcacccagagcaatgccatcctgcgctacattgcccgcaagcacaacctgtgtggggagacagaagaggagaagattcgtgtggacattttggagaaccagaccacggacaactggatgcaactggtcatgatctgctaccacccagagtttgagaaactgaagccaaaatacttggaggaactccctgaaaagctaaagctctactcagagtttctggggaagcggccatggtttgcaggagacaagatcacctttgtggatttccttgcctatgatgtccttgacatgaagcgtatatttgagcccaagtgcttggacgccttcctaaacttgaaggacttcatctcccgctttgagggtttgaagaagatctctgcctacatgaagtccagccaattcctccgaggtcttttgtttggaaagtcagctacatggaacagcaaatag

SEQ ID NO: 137823 - DNA, 4370 bp, Homo sapiens
  Payload ID: 6991
  Gene Symbol: GSTM5
  Gene Name: glutathione S-transferase mu 5
  ENST ID: ENST00000369813
  CDS Start-End: 906-1514
aaagtctgagccccgctccgctgatgcctgtctgcagaatccgcaccaaccagcaccatgcccatgactctggggtactgggacatccgtgggctggcccacgccatccgcttgctcctggaatacacagactcaagctatgtggaaaagaagtacacgctgggggacggtaatggcaccctcgtgtccgggccctgcccactcacgctgagttggcaccaagcaacccatggtggccacctgtggctgcctctgcaggcctcccctgctggagctgcaggctgtcccttccctgagctcccgtgagtgagccctctggccttgcaaggcagaatgctggggcgggatgctggacaccctgtctaattgggttgggtgtccctcagagcttccctaaaccctggaagccttagccgttgtggggtccagagccctcagtgggattctttctccctgaaccctgggatgtgggactgagtggtcagattctagatccacctgtctcagggatcttgccactggctccttgggagggtccccgggaaggagggctgggctctggggaggtttgttttcacttcttccccaccacagctcctgactatgacagaagccagtggctgaatgaaaaattcaagctgggcctggactttcccaatgtaggtgcaggggaaggggcggttttgggggaaagtgcgacgtgtctctgactgcatctcctctccccaccttagaggtgttaagatcaggagtcttctgcccaattcctctcactcttggctgtctacacagcccttgcatgatgttctgtgtcccagctcatttattagtgtgacagtatttctatctcaggcctgccatgagcaggccctggtctcctctctgcccttgcatatgggaaggggatgctggggagcctggtggcccaactgagcttccccggtttcccatctatccagctgccctacttgattgatggggctcacaagatcacccagagcaatgccatcctgcgctacattgcccgcaagcacaacctgtgtggggagacagaagaggagaagattcgtgtggacattttggagaaccaggttatggataaccacatggagctggtcagactgtgctatgacccagattttgagaaactgaagccaaaatacttggaggaactccctgaaaagctaaagctctactcagagtttctggggaagcggccatggtttgcaggagacaagatcacctttgtggatttccttgcctatgatgtccttgacatgaagcgtatatttgagcccaagtgcttggacgccttcctaaacttgaaggacttcatctcccgctttgaggtgatgcccccatcctcctttctctttgatgccccttgttcctttctctcctttcagatgctttcccagtcctggagctacacaaagaataactcgtatgtattgagtacgggcttcatgccaggaatcatgcccagcacattatacctatcgtgtagaatttgaaatttccaacattcctacagggtgacagaattatcttgcccattttagagataagaaaactgagaatgagagggtcagtcctttgctcagggtcccagagccagtggaggctgtgctgggctccctgtgagcctctggatctatgggtggcagtcagggctctcccatttgtgacaaaaggagaagcctcaggcctcatccagcctgggtttcacagcccagaacactttgaaagaggcagagcacttcaggaccacggatgcagctggcaatagtaggactgacacacagtggcattgatgttgagtactaaacctgcaggcagtattcatagccacccccagaagctttgcatgatcggacccccatgtggaaaatcctgagatccggagctgtggctggagctggattagggtacatatgtgggtgcccctgttgaagcagtgtgtgttgaagtgctctgtgctggggcactctccttctttatctttcttcctctctttttttccctccaatgttccacgtcttccccctgtgagatgagtagcacactgattttactcctattcaccgaccttctcctctgcatgaggcagggtgtgaggcacagtgggagttgcatagatgactgccccatcctggaaatgagtgcagtgagaggcctgcaggcagagcagcctgtgaggtgtgtgtggcaccacctgggtaccgggcctggggcctgcccctcactcacggggaaccatccctcacctgtgttgaagttgtttgagagcagcaaatcctactttagtacagatttggggatttgaggcattagtccaacaggcttctgagcctagaatctgtttccctttcccactccccatcaagaaatctgcttgctcagctagttcccatcagctctggttctggtccagcctgagcagccttggggttatgtaagaggtggtgggaggggagcggtggggaacagccgagggctggggcatggagcctgcctgggcctggccctggccctttggggagagggagccctggatctctttgaattctttagaagttacatggtcattgaatcctggtaagattgtgtgcagcacacctgagtgtcatgtggcctggctagcagtagtagggctggagatgtgatgggggcacagggacatagggagatttagctcaggtaccaggtggagaagtttggactttatgctttaatgggaatgattagagcctggtctggccttcctttggtggttcacccttaccctattcagtttcatccaggttttgctaagtcattgggtgagatctgtgctctcttcttggctgcacaggtgtgttctgagcccctttgttctgctggaggtcctttctgtgtgtgcaatcctaggcaagccaagaacctccctgtgaaaaaggagaatgtttgtgccgacaaggagtgacaggatctggcatggggtgtggctgggtggaagaggaggagaatttggcaaaaacatgctagaactgaagacagaaccaggctatattccagccctgtcccacttactagctatttgagtgtgaggaagttgctgaacttctgttcttctatatgagaaacggtgataatagaactgaccatggagggtagtcgagtggattttctaagcctgtgttgtaatttctgttggatataaagcacccagcacagtgtagatctttcgtaaatggtagctgttattatggtataacattacttaaaggaagttggaagagttaacttagaagagctggggacctaagagaccgtgtgatgctccagcacttgagcccacatggaaaggctgtggccagggccctgacctgctgtgcctgcagcaaagctacttgagcccttctagacagcagacctggctctggccccttcttcccgccctcagggtttgaagaagatctctgcctacatgaagtccagccaattcctccgaggtcttttgtttggaaagtcagctacatggaacagcaaatagggcccagtgatgccagaagatgggagggaggagccaaccttgctgcctgcgaccctggaggacagcctgactccctggacctgccttcttcctttttccttctttctactctcttctcttccccaaggcctcattggcttcctttcttctaacatcatccctccccgcatcgaggctctttaaagcttcagctccccactgtcctccatcaaagtccccctcctaacgtcttcctttccctgcactaacgccaacctgactgcttttcctgtcagtgcttttctcttctttgagaagccagactgatctctgagctccctagcactgtcctcaaagaccatctgtatgccctgctccctttgctgggtccctaccccagctccgtgtgatgcccagtaaagcctgaaccatgcctgccatgtcttgtcttattccctgaggctcccttgactcaggactgtgctcgaattgtgggtggttttttgtcttctgttgtccacagccagagcttagtggatgggtgtgtgtgtgtgtgtgttgggggtggtgatcaggcaggttcataaatttccttggtcatttctgccctctagccacatccctctgttcctcactgtggggattactacagaaaggtgctctgtgccaagttcctcactcattcgcgctcctgtaggccgtctagaactggcatggttcaaagaggggctaggctgatggggaagggggctgagcagctcccaggcagactgccttctttcaccctgtcctgatagacttccctgatctagatatccttcgtcatgacacttctcaataaaacgtatcccaccgt

SEQ ID NO: 137824 - DNA, 900 bp, Homo sapiens
  Payload ID: 6992
  Gene Symbol: GSTO1
  Gene Name: glutathione S-transferase omega 1
  Uniprot ID: P78417
  ENST ID: ENST00000369710
  CDS Start-End: 220-846
cccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaatatg

SEQ ID NO: 137825 - DNA, 972 bp, Homo sapiens
  Payload ID: 6992
  Gene Symbol: GSTO1
  Gene Name: glutathione S-transferase omega 1
  Uniprot ID: P78417
  ENST ID: ENST00000369713
  CDS Start-End: 195-920
acagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaata

SEQ ID NO: 137826 - DNA, 592 bp, Homo sapiens
  Payload ID: 6992
  Gene Symbol: GSTO1
  Gene Name: glutathione S-transferase omega 1
  ENST ID: ENST00000432659
  CDS Start-End: 51-592
gaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctg

SEQ ID NO: 137827 - DNA, 829 bp, Homo sapiens
  Payload ID: 6992
  Gene Symbol: GSTO1
  Gene Name: glutathione S-transferase omega 1
  ENST ID: ENST00000445155
  CDS Start-End: 228-829
gggggtgatctcggcgacccccggcggcatgttcgaggctgctccgggagcccagccgcccgggagcgccccaccggcggggaacgggtcggagctgcagtgggacgcgggggcggtgggatacggggggtctcgacacctctctgggccgtaatcgccttcgcttctccccggcaggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctcta

SEQ ID NO: 137828 - DNA, 1052 bp, Homo sapiens
  Payload ID: 6992
  Gene Symbol: GSTO1
  Gene Name: glutathione S-transferase omega 1
  Uniprot ID: P78417
  ENST ID: ENST00000539281
  CDS Start-End: 357-998
aaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaatatg

SEQ ID NO: 137829 - DNA, 1179 bp, Homo sapiens
  Payload ID: 6993
  Gene Symbol: GSTO2
  Gene Name: glutathione S-transferase omega 2
  Uniprot ID: Q9H4Y5
  ENST ID: ENST00000338595
  CDS Start-End: 321-1052
cgcctccttgctgctgctgccgccgccaatcctggtccggttgcccgagttcccggaggtctctcgcgggacctctctcaccgccaccgctcctactctcgggcttccaaatctggggcgatgtctccccaggttaaattaccctagctcctgctccagatcgcttccccgtgccccgccagagcccagtagttcaaaaattaaatttggggcaaggggtgcgcgccagagcgcagctgtttctggagcctgcggcagcggtggcgagccacagggcggcgaccgtgagctccgggagctgcgcaaaccacctggagaccatgtctggggatgcgaccaggaccctggggaaaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaaggtcccacatttgaccaaggagtgcctggtagcgttgagatgtgggagagaatgcactaatctgaaggcagccctgcgtcaggaattcagcaacctggaagagattcttgagtatcagaacaccaccttctttggtggaacctgtatatccatgattgattacctcctctggccctggtttgagcggctggatgtgtatgggatactggactgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacagg

SEQ ID NO: 137830 - DNA, 6423 bp, Homo sapiens
  Payload ID: 6993
  Gene Symbol: GSTO2
  Gene Name: glutathione S-transferase omega 2
  Uniprot ID: Q9H4Y5
  ENST ID: ENST00000369707
  CDS Start-End: 115-762
gctccttcctcaccgggctgactagcctctcctttccctgtccccctccatcgctgctctgcaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaaggtcccacatttgaccaaggagtgcctggtagcgttgagatgtgggagagaatgcactaatctgaaggcagccctgcgtcaggaattcagcaacctggaagagattcttgagtatcagaacaccaccttctttggtggaacctgtatatccatgattgattacctcctctggccctggtttgagcggctggatgtgtatgggatactggactgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacaggaaatgtattcttctgataatcatttgtctgactcctctagcctgtagctgctgctactgctgcttttttttcctttttttttttgaggcaagatcttgcttcgttactcaggctggagtgcagtgggacagtcggctcactgcagccttgaactcctgggctcagttgattctcccgcctcagcctcctgagaagctaggactacaggtatgtgtcaccacgcccagctaatttttaaaaaaatgttgttgagacagggtctcactatgttgctcaggctggtctccatctcctggccgcaagccatccacccaacttggtctccaaagtgttgagattacaggcatgagccacctggcctgcctagcctgtagcttctaactattttctagaaagtgcctggtgctaatgtcagagcacattttgggagcctgtgtgcctcctaactccttggccttcagcctagtttgatctccagattattggtgcagatgctgatgctgaggttcagggtcaacctatgactgatgcttgtcactacagaatggcaccctccaaagacctccctggtgaaagcttaagaagagggagaaggaagaagaaaacactccaaacctaaataccttccatttggcaaatgaatgtcgctgtccacgtgggcgagtatgagtgtaattctccaaactttggccatgggcctggagacaccgagggtcttgtgactggaaagaattccaaagcaggaaatgaaacaccggtttatcacccaggactaactacgtcagaatttcactggtgctgtcagggctcaggatgtctcacaaaatgttctatagccggcatcctgccttaaaaaaatacacacgccccaaacccagccacaagcaaaggtcattccgttggatttgcgtcacactctcttccaattcatctcaacaaatgcctctggttgcctgttgtgtaccaagcccaggggcacactggggataaagttgaaaaagacattggctctgtccctgggagcccccatctctccacttatcttggttgaggttttaaacctagcgctttggagctgcttgtctgttgtagggatgcttgtctctgatgtggcccctctgccagcttcgccaggcagtaccaccccactgaagacagcaaagagctgaggatggctggtgccaacaggtcccttgggctgggagcatctactgcctgcactatgggagggggaccaagtttgtccaatgctgtttcatctcagtgtctgaggatcagcctgtgatcatttcagctttgctcatgctggatcctttcccatcctcctagctgtgctgagacaccaggcagcaacaggagcgatgttttgccttgtctgtgctccctaaggagctgtctgccacctctgcctctgagacagcccaaatcagccctcctctctccccacgtctcagtctggccctgccatctgctggctctgggtatattttgacccatgtaaatagttaccaggtgttactctgtgccagctggacagaaacaagcctgcttggtgaggtggccagaacttccagaagaggcagcgcatgacaggggcagtctgccgcaccatctgctccggatgtggagccctgttgccatggcaccctagttaatgctgagtgaggtctgtgaatcaccgttttcctgggatctttgctccaagaagaggggaatcttctcctgtggcctctcataggacttaggagattgatcagccttttgccggtacaaatcctgcatgctagtgagtgcttgtcataagaccaaagttaccactgatgcaacaggaaatggcatgcctctggctcaccaaaatgaaggtgttctcttttggggctccgcacactaatttagaaagcttgaagaaccaggaattatagaatggagaaaagcactcatgggggaggtttgcagcctggtggcctatagcccagtttgggatttgagtgcctcttggccaggcatgctccctgctgtttaccagggtcctggtcacctgcacatccttacacttcctccatctcgcttctttgtcacttgtctgacccacagagaaaactgagttatcaatctttgaataaaactagaaggatgtggcctggagaaaagagggaaggaggtaattaaataatgctccatgaagaactttaaaaatatgcttcttaattaatacatgtggaaagaatacatatgggttaaaaatacaataatgtaaaagaatagaaaatcttccattatcttgtgtcctagagataaccacttttagtaattggtgtctacctttttttccccttttcttttaaataatagagatggggtttcgctatgttgaccaggctggtcttgaactcctggcttcaagtgatcctcccatctcggcatcccaaagtgctgggattataggtctgagtcatcatgcctggtgggtgtctatcttataaaaagcactaaacttaaagatttaaaggtgagagcctgtattaggccattctcatggtgctataaagaactgcccaagactgagtaatttataaaggaaagaggtttaattgactcacaattccacatggctggggaagcctcaggaaactttcaatcatggtggaaggggaagcaaacatgtccttctgcacaaggtggcagaagagagaagtacagagccaaagagggaaaaactccttataaaaccattagatctcatgagaactcactcactgtcatgagaaaagcatagggaaaacactcccacaatcgaatcacctcccttgaggtccctcccccaacatgtggggattataattcagattaaaattgaagatgagattttaggtggagcacagccaaaccatatcagagccattctctatcttttgcagattggaaaaataaaaaaattagtttaaaccacagcatttaaaagaaatggtcatagatgatgttaacatcagaatggaggttgtgtggagttcccctccttggaggttctgagctacagcctagcctggactcagtccagttacaatctaacatggctagggggaggagggagcatgatggggcagggcttgtgtggctgggacagctggctatggtcgtggtgctggtgactaaatggtacttgaaatttcttttagatctaaaattctgtgatatggtttggatctgagaccccaccaaatttcgtgttgaaatgtaatccccaatgctggtgggaggtgattggatcatgggggtagatttctcatgaatggtttagcaccattctcttggtgctgttctcatgatagtgagtgagttctcatgagttctggttgtttaaaagtgtgcagcatctccctgacccctcttgcgccagctcccaccatgggagatgcctcgctccccctttgctttttgccatgagaggaagcttcctgagggctctccagaagcagaatctactacacttctcatacagcctgcagaaccatgagccaattaaacctctttttaaaaacacttttattttaagttcaggggtacatgtgcaggatgtgcaggttcgttccataggtaaacatgcgtcatggggtttgttatgcagattatttcatcacctagatattaagtctagtatccattagttatttttcctgatcctctccctcctcccaccctgcaccctctgataggcctcagtgtgtattgttaccctccacatgtccatgtgttctcatgatttagctcccacttataagtgagaacatgcagtttttgtaaacctgttttctttagggaaagtttagaattttctagagactggttgtatggttgtgaccaaaatgccagtagtgatatggacagtgaaggccaggctgaggaggtgatggaaatgaggaacttactgggaactggagcaaaggtcacttttgttatgctttagcaaagaacttggctgcattgtgctcctggcctagggacctgtggaagtttgaacttgagagtgatgattttagggtatctggcagaaaaaatttctaagcagcaaagcattcaagatgcgccctggctgctttcaacaacctatgctcatatttgtgagcaaagaaattatgttaagttggaacttatatttacaggggaagcagagcgtaaaagtttggagaatttgcagccagctatgtggtagaaaagaagagcccgttttcagggaaggaattcaagcaggctgcagaaatttgcataagtaaaaaggagccaagtgctaatggccaagaaaatggggaaaaggccttgaaggcatttcagagacctttgtggcagcccctcccatcacagactcagaggcctaggaggacagaatgactctgagtattaaagtagatttaatctaaatcataaagtacaagctagagcaatccctccagtgctgcagaaactgcctgcatgtggctcccacattgtttcttggagctttggtggtggtaggggtggcaggggcaggtgttatgtttcttggtttctcaccttcaggtctccttacccatgtttcctttgtcagagtcattggccttgatggaggggagactgggttactctgagttgagaagcaagcttgactgccctgtggtttatatcagcctagcttagtttgttttctgaagtcttcacaaataaccaaatatccagcccagtgcagttctcaatgagtagtctccagttcccatcccccaccacacacacacaccaaacactgtgcccacctgggagacccattttcatttatcttcttctttgagtgcctggaaggctgaacatttgatcttttcaaacatttttctctcatctggcctgttagcgctcttgagcctttgaaaatgccatttcctctacatactattcttcctcagagcagccctctgtttttttttccaaccagtcttttctcttgcaaagttcagatcaaaattcttctttatgtaaagagaagtggcgtgccataggggttacaaacagggcttcaaggttagcactgggatcaaattccgactttgcaacttaactttcttgagtaagttgctacacctctattagcctcagtttcttatctgtaaaatgggacggctaagtacctatttcattgggctgttgaataatgatggtctcatctatgcaagggcttagtaccagctgggtgaaactcagtgaatggcaggcaaccctattatgactaggcttctgccaatgatcagacttgaaccctgtgctcatccccccatcactttgtggaactagatgtcctacgttgcacatggcttgattcatggtttggagttgttttctggttgtttcctgtgtgcaggtttaatctcaacctgtgatcccttgaaagctgcaattttatccctccccgtcctcctccctctcaccccaaggccaagtttaatactgtgcattctgaaatcttgcaatgttgatgatgtaaaataaatcttctctcctgtgtttctgaa

SEQ ID NO: 137831 - DNA, 1391 bp, Homo sapiens
  Payload ID: 6993
  Gene Symbol: GSTO2
  Gene Name: glutathione S-transferase omega 2
  Uniprot ID: Q9H4Y5
  ENST ID: ENST00000450629
  CDS Start-End: 629-1258
accacctctgctgccgcgcgcctaccggagccgcttggccctagtgctttccagcggatttcccctcaggtgcggagccgggtgccggggtcccacagccaaccactaccggttcctctttcgtcagccaccggcgccggcaggacccgcgaatcccgatctccaggagcctgtaaggaggccgcccattggctcagccgcactgctgggcaggtacttccaaagctttgaggattggctgatgctctgggcgccggggctagttggcgggtaggatcacgtgcgaggggcaggccccgtctaggccccgcctccttgctgctgctgccgccgccaatcctggtccggttgcccgagttcccggaggtctctcgcgggacctctctcaccgccaccgctcctactctcgggcttccaaatctggggcgatgtctccccaggttaaattaccctagctcctgctccagatcgcttccccgtgccccgccagagcccagtagttcaaaaattaaatttggggcaaggggtgcgcgccagagcgcagctgtttctggagcctgcggcagcggtggcgagccacagggcggcgaccgtgagctccgggagctgcgcaaaccacctggagaccatgtctggggatgcgaccaggaccctggggaaaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaagattcttgagtatcagaacaccaccttctttggtggaacctgtatatccatgattgattacctcctctggccctggtttgagcggctggatgtgtatgggatactggactgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacaggaaatgt

SEQ ID NO: 137832 - DNA, 700 bp, Homo sapiens
  Payload ID: 6994
  Gene Symbol: GSTP1
  Gene Name: glutathione S-transferase pi 1
  ENST ID: ENST00000398603
  CDS Start-End: 103-627
gccgtgactcagcactggggcggagcggggcgggaccacccttataaggctcggaggccgcgaggccttcgctggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagag

SEQ ID NO: 137833 - DNA, 965 bp, Homo sapiens
  Payload ID: 6994
  Gene Symbol: GSTP1
  Gene Name: glutathione S-transferase pi 1
  Uniprot ID: P09211
  ENST ID: ENST00000398606
  CDS Start-End: 250-882
tgggaaagagggaaaggcttccccggccagctgcgcggcgactccggggactccagggcgcccctctgcggccgacgcccggggtgcagcggccgccggggctggggccggcgggagtccgcgggaccctccagaagagcggccggcgccgtgactcagcactggggcggagcggggcgggaccacccttataaggctcggaggccgcgaggccttcgctggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagctactatgag

SEQ ID NO: 137834 - DNA, 221 bp, Homo sapiens
  Payload ID: 6994
  Gene Symbol: GSTP1
  Gene Name: glutathione S-transferase pi 1
  ENST ID: ENST00000495996
  CDS Start-End: 1-210
gaggcgggcaaggatgactatgtgaaggcactgcccgggcaactgaagccttttgagaccctgctgtcccagaaccagggaggcaagaccttcattgtgggagaccaggtgagcatctggccccatgctgttccttcctcgccaccctctgcttccagatggacacaggtatctccttcgctgactacaacctgctggacttgctgctgatccatgaggtc

SEQ ID NO: 137835 - DNA, 723 bp, Homo sapiens
  Payload ID: 6994
  Gene Symbol: GSTP1
  Gene Name: glutathione S-transferase pi 1
  ENST ID: ENST00000498765
  CDS Start-End: 1-239
gccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttggctggggctcacagacagccccctggttggcccatccccagtgactgtgtgttgatcaggcgcccagtcacgcggcctgctcccctccacccaaccccagggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggc

SEQ ID NO: 137836 - DNA, 955 bp, Homo sapiens
  Payload ID: 6995
  Gene Symbol: GSTT1
  Gene Name: glutathione S-transferase theta 1
  ENST ID: ENST00000621513
  CDS Start-End: 37-171
ccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaagtgtggccatcctgctctacctgacgcgcaaatataaggtccctgactactggtaccctcaggacctgcaggcccgtgcccgtgtggatgagtacctggcatggcagcacacgactctgcggagaagctgcctccgggccttgtggcataaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcctaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctgggctcagcctgagcctctgcttctaa

SEQ ID NO: 137837 - DNA, 1060 bp, Homo sapiens
  Payload ID: 6995
  Gene Symbol: GSTT1
  Gene Name: glutathione S-transferase theta 1
  Uniprot ID: P30711
  ENST ID: ENST00000612885
  CDS Start-End: 54-776
actggagtttgctgactccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaaggtcagcacttaagcgatgcctttgcccaggtgaaccccctcaagaaggtgccagccttgaaggacggggacttcaccttgacggagagtgtggccatcctgctctacctgacgcgcaaatataaggtccctgactactggtaccctcaggacctgcaggcccgtgcccgtgtggatgagtacctggcatggcagcacacgactctgcggagaagctgcctccgggccttgtggcataaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcctaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctgggctcagcctgagcctctgcttctaa

SEQ ID NO: 137838 - DNA, 559 bp, Homo sapiens
  Payload ID: 6995
  Gene Symbol: GSTT1
  Gene Name: glutathione S-transferase theta 1
  ENST ID: ENST00000628417
  CDS Start-End: 365-559
agtgttgagccaagaggatggactttggagccagactttctgggtctataatcattcagtgtctgtctcctcctctaaaatgcggacggtgggaaattctgacacacgcttcaacacagatgcaccttgaagacattatgctaagtgaaatgagcgagccaggcacgaaagggatgggactggggcctctctgtgcgtccccctgagagacaacggtctcttggccacccaccctgatcccacaggagccaggcgggcccagccctgagacaggccgcccgccgcccgcaattggactaaagagtgtcccaggcgtccgtgccgcccaatggggcacagcggtcggggtcggtcggtccccactatgggcctggagctgtacctggacctgctgtcccagccctgccgcgctgtttacatctttgccaagaagaacgacattcccttcgagctgcgcatcgtggatctgattaaaggtcagcacttaagcgatgcctttgcccaggtgaaccccctcaagaaggtgccagccttgaaggacggggacttcaccttgacg

SEQ ID NO: 137839 - DNA, 617 bp, Homo sapiens
  Payload ID: 6995
  Gene Symbol: GSTT1
  Gene Name: glutathione S-transferase theta 1
  ENST ID: ENST00000629554
  CDS Start-End: 35-172
ctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttg

SEQ ID NO: 137840 - DNA, 974 bp, Homo sapiens
  Payload ID: 6995
  Gene Symbol: GSTT1
  Gene Name: glutathione S-transferase theta 1
  ENST ID: ENST00000628171
  CDS Start-End: 29-322
tttccggtcaggtcggtcggtccccactatgggcctggagctgtacctggacctgctgtcccagccctgccgcgctgtttacatctttgccaagaagaacgacattcccttcgagctgcgcatcgtggatctgattaaaggtcagcacttaagcgatgcctttgcccaggtgaaccccctcaagaaggtgccagccttgaaggacggggacttcaccttgacggagaggacctgcaggcccgtgcccgtgtggatgagtacctggcatggcagcacacgactctgcggagaagctgcctccgggccttgtggcataaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcctaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctgggctcagcctgagcctctgcttctaa

SEQ ID NO: 137841 - DNA, 218 bp, Homo sapiens
  Payload ID: 6995
  Gene Symbol: GSTT1
  Gene Name: glutathione S-transferase theta 1
  ENST ID: ENST00000627958
  CDS Start-End: 22-218
tcaggtcggtcggtccccactatgggcctggagctgtacctggacctgctgtcccagccctgccgcgctgtttacatctttgccaagaagaacgacattcccttcgagctgcgcatcgtggatctgattaaagcccgtgggtgctggctgccaagtcttcgaaggccgacccaagctggccacatggcggcagcgcgtggaggcagcagtgggggagg

SEQ ID NO: 137842 - DNA, 485 bp, Homo sapiens
  Payload ID: 6995
  Gene Symbol: GSTT1
  Gene Name: glutathione S-transferase theta 1
  ENST ID: ENST00000630428
  CDS Start-End: 22-162
tcaggtcggtcggtccccactatgggcctggagctgtacctggacctgctgtcccagccctgccgcgctgtttacatctttgccaagaagaacgacattcccttcgagctgcgcatcgtggatctgattaaaggacctgcaggcccgtgcccgtgtggatgagtacctggcatggcagcacacgactctgcggagaagctgcctccgggccttgtggcataaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggagg

SEQ ID NO: 137843 - DNA, 584 bp, Homo sapiens
  Payload ID: 6995
  Gene Symbol: GSTT1
  Gene Name: glutathione S-transferase theta 1
  ENST ID: ENST00000628465
  CDS Start-End: 41-385
gactccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaagacggagtctcgctctgtcgcccaggctggagtgcagtggcaggatcacagctcactgcaacctctgccgcccgaaaccttgtcctctgcctcttgttcctgctggggaggtcagcacttaagcgatgcctttgcccaggtgaaccccctcaagaaggtgccagccttgaaggacggggacttcaccttgacggagagtgtggccatcctgctctacctgacgcgcaaatataaggtccctgactactggtaccctcaggacctgcaggcccgtgcccgtgtggatgagtacctggcatggcagcacacgactctgcggagaagctgcctccgggccttgtggcataaggtgatgttccctgttttcctgggtgagccagtatctccccagacactggcagccaccctggcagagttggatgtgaccctgcag

SEQ ID NO: 137844 - DNA, 348 bp, Homo sapiens
  Payload ID: 6995
  Gene Symbol: GSTT1
  Gene Name: glutathione S-transferase theta 1
  ENST ID: ENST00000628470
  CDS Start-End: 18-335
gtcggtcggtccccactatgggcctggagctgtacctggacctgctgtcccagccctgccgcgctgtttacatctttgccaagaagaacgacattcccttcgagctgcgcatcgtggatctgattaaaggtcagcacttaagcgatgcctttgcccaggtgaaccccctcaagaaggtgccagccttgaaggacggggacttcaccttgacggagagcccgtgggtgctggctgccaagtcttcgaaggccgacccaagctggccacatggcggcagcgcgtggaggcagcagtgggggaggacctcttccaggaggcccatgaggtcattctgaaggccaaggactt

SEQ ID NO: 137845 - DNA, 726 bp, Homo sapiens
  Payload ID: 6995
  Gene Symbol: GSTT1
  Gene Name: glutathione S-transferase theta 1
  ENST ID: ENST00000628969
  CDS Start-End: 16-696
cggtcggtccccactatgggcctggagctgtacctggacctgctgtcccagccctgccgcgctgtttacatctttgccaagaagaacgacattcccttcgagctgcgcatcgtggatctgattaaagacggagtctcgctctgtcgcccaggctggagtgcagtggcaggatcacagctcactgcaacctctgccgcccgaaaccttgtcctctgcctcttgttcctgctggggaggtcagcacttaagcgatgcctttgcccaggtgaaccccctcaagaaggtgccagccttgaaggacggggacttcaccttgacggagaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctc

SEQ ID NO: 137846 - DNA, 937 bp, Homo sapiens
  Payload ID: 6996
  Gene Symbol: GSTT2
  Gene Name: glutathione S-transferase theta 2 (gene/pseudogene)
  ENST ID: ENST00000402588
  CDS Start-End: 141-833
gtgcgctccaattgggtgctgtccccagggggtggggcctgatcccctatttcccggcgcgccgggatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaagggcagcacaagagcaaggagttcttgcagatcaacagcctggggaaactgccgacgctcaaggatggtgatttcatcttgaccgaaagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccagatgttggggccactcattggggtccaggtgcccgaggagaaggtggaacgcaacaggactgccatggaccaggccctgcaatggctggaggacaagttcctgggggacaggcccttcctcgctggccagcagccggtggctctcggctatgaactgtttgagggacggccacgactggcagcatggcgtggatgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagctt

SEQ ID NO: 137847 - DNA, 1094 bp, Homo sapiens
  Payload ID: 6996
  Gene Symbol: GSTT2
  Gene Name: glutathione S-transferase theta 2 (gene/pseudogene)
  Uniprot ID: P0CG29
  ENST ID: ENST00000618279
  CDS Start-End: 51-785
ccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaagggcagcacaagagcaaggagttcttgcagatcaacagcctggggaaactgccgacgctcaaggatggtgatttcatcttgaccgaaagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgttggggccactcattggggtccaggtgcccaaggagaaggtggaacgcaacaggactgccatggaccaggccctgcaatggctggaggacaagttcctgggggacaggcccttcctcgctggccagcaggtgacactggctgatctcatggccctggaggagctgatgcagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaa

SEQ ID NO: 137848 - DNA, 1112 bp, Homo sapiens
  Payload ID: 6996
  Gene Symbol: GSTT2
  Gene Name: glutathione S-transferase theta 2 (gene/pseudogene)
  ENST ID: ENST00000621118
  CDS Start-End: 76-807
gatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaagggcagcacaagagcaaggagttcttgcagatcaacagcctggggaaactgccgacgctcaaggatggtgatttcatcttgaccgaaagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccagatgttggggccactcattggggtccaggtgcccgaggagaaggtggaacgcaacaggactgccatggaccaggccctgcaatggctggaggacaagttcctgggggacaggcccttcctcgctggccagcaggtgacactggctgatctcatggccctggaggagctgatgcagccggtggctctcggctatgaactgtttgagggacggccacgactggcagcatggcgtggagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatag

SEQ ID NO: 137849 - DNA, 1184 bp, Homo sapiens
  Payload ID: 6996
  Gene Symbol: GSTT2
  Gene Name: glutathione S-transferase theta 2 (gene/pseudogene)
  ENST ID: ENST00000634759
  CDS Start-End: 141-875
gtgcgctccaattgggtgctgtccccagggggtggggcctgatcccctatttcccggcgcgccgggatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaagggcagcacaagagcaaggagttcttgcagatcaacagcctggggaaactgccgacgctcaaggatggtgatttcatcttgaccgaaagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccagatgttggggccactcattggggtccaggtgcccgaggagaaggtggaacgcaacaggactgccatggaccaggccctgcaatggctggaggacaagttcctgggggacaggcccttcctcgctggccagcaggtgacactggctgatctcatggccctggaggagctgatgcagccggtggctctcggctatgaactgtttgagggacggccacgactggcagcatggcgtggatgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaa

SEQ ID NO: 137850 - DNA, 1099 bp, Homo sapiens
  Payload ID: 6997
  Gene Symbol: GSTT2B
  Gene Name: glutathione S-transferase theta 2B (gene/pseudogene)
  Uniprot ID: P0CG30
  ENST ID: ENST00000290765
  CDS Start-End: 56-790
ccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaagggcagcacaagagcaaggagttcttgcagatcaacagcctggggaaactgccgacgctcaaggatggtgatttcatcttgaccgaaagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgttggggccactcattggggtccaggtgcccgaggagaaggtggaacgcaacaggactgccatggaccaggccctgcaatggctggaggacaagttcctgggggacaggcccttcctcgctggccagcaggtgacactggctgatctcatggccctggaggagctgatgcagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaa

SEQ ID NO: 137851 - DNA, 819 bp, Homo sapiens
  Payload ID: 6997
  Gene Symbol: GSTT2B
  Gene Name: glutathione S-transferase theta 2B (gene/pseudogene)
  ENST ID: ENST00000404172
  CDS Start-End: 23-715
cgctgtccttgccgcccccgccatgggcctagagctgtttcttgacctggtgtcccagcccagccgcgccgtctacatcttcgccaagaagaatggcatccccttagagctgcgcaccgtggatttggtcaaagggcagcacaagagcaaggagttcttgcagatcaacagcctggggaaactgccgacgctcaaggatggtgatttcatcttgaccgaaagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgttggggccactcattggggtccaggtgcccgaggagaaggtggaacgcaacaggactgccatggaccaggccctgcaatggctggaggacaagttcctgggggacaggcccttcctcgctggccagcagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagctt

SEQ ID NO: 137852 - DNA, 1115 bp, Homo sapiens
  Payload ID: 6997
  Gene Symbol: GSTT2B
  Gene Name: glutathione S-transferase theta 2B (gene/pseudogene)
  ENST ID: ENST00000616938
  CDS Start-End: 76-810
gatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaagggcagcacaagagcaaggagttcttgcagatcaacagcctggggaaactgccgacgctcaaggatggtgatttcatcttgactgaaagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgttggggcccctcattggggtccaggtgcccgaggagaaggtggaacgcaacaggactgccatggaccaggccctgcaatggctggaggacaagttcctgggggacaggcccttcctcgctggccagcaggtgacactggctgatctcatggccctggaggagctgatgcagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatag

SEQ ID NO: 137853 - DNA, 1338 bp, Homo sapiens
  Payload ID: 6998
  Gene Symbol: GSTZ1
  Gene Name: glutathione S-transferase zeta 1
  ENST ID: ENST00000216465
  CDS Start-End: 286-936
agagcatgtcgggaccgggagggccggccggcccggggcgggggggactgggcaggaggggtcgggctcagggaactgcaactcccagcagcccccaggtacggggcgtggcgggagagctgggcgagccagaggcgaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagatgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaacaccacggggaaggctgtgtgccttttctcatccgcttttgttgtgtgtgactccaaagaatgcccgcgctgaaatttggcgtgaattaaactgaagcccaggcctcta

SEQ ID NO: 137854 - DNA, 867 bp, Homo sapiens
  Payload ID: 6998
  Gene Symbol: GSTZ1
  Gene Name: glutathione S-transferase zeta 1
  ENST ID: ENST00000349555
  CDS Start-End: 145-669
gaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcaaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcgggg

SEQ ID NO: 137855 - DNA, 1010 bp, Homo sapiens
  Payload ID: 6998
  Gene Symbol: GSTZ1
  Gene Name: glutathione S-transferase zeta 1
  Uniprot ID: O43708
  ENST ID: ENST00000361389
  CDS Start-End: 525-1010
gggagagctgggcgagccagaggcgaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagtggtcaccagcagtccctgtcccttggcaccaggagtccctgtagcctggctaggtaaggaaagggagttgcatctccaaataaggaagatccagttgtggccacccaattcctcctcttcgaaagacactttctgcccatcacctgctttctgtgccaggaccatctttactttctccacaaaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagatgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctag

SEQ ID NO: 137856 - DNA, 1424 bp, Homo sapiens
  Payload ID: 6998
  Gene Symbol: GSTZ1
  Gene Name: glutathione S-transferase zeta 1
  Uniprot ID: O43708
  ENST ID: ENST00000393734
  CDS Start-End: 538-1023
ccgggagggttgggccagaggaggcggtcctggtagggagtgcgtagcagggtggagtcgctgtccggtcgcgcttcacttctgctccgccctccctgctccccataacagacccctccctccactaaggcttccaaacgtcgccccaagcctcccaatttctcgcagcccttcatgctcttctcttggccctagcaggagtggtcaccagcagtccctgtcccttggcaccaggagtccctgtagcctggctaggtaaggaaagggagttgcatctccaaataaggaagatccagttgtggccacccaattcctcctcttcgaaagacactttctgcccatcacctgctttctgtgccaggaccatctttactttctccacaaaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagatgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaacaccacggggaaggctgtgtgccttttctcatccgcttttgttgtgtgtgactccaaagaatgcccgcgctgaaatttggcgtgaattaaactgaagcccaggcctct

SEQ ID NO: 137857 - DNA, 919 bp, Homo sapiens
  Payload ID: 6998
  Gene Symbol: GSTZ1
  Gene Name: glutathione S-transferase zeta 1
  ENST ID: ENST00000556627
  CDS Start-End: 132-701
agtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacgagacggtgcccatcaatctcataaaggatgggggccaacagctggccatcattgagtatctagaggagatgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatac

SEQ ID NO: 137858 - DNA, 580 bp, Homo sapiens
  Payload ID: 6998
  Gene Symbol: GSTZ1
  Gene Name: glutathione S-transferase zeta 1
  ENST ID: ENST00000557053
  CDS Start-End: 205-564
tgattcgtcgagtctcactgagccttagtcgtcggcaggtcccaggcgcgaagtttctcggcctggaggagggggtcgcgcgaagtgccagatgcaggcggggaagctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcaaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccc

SEQ ID NO: 137859 - DNA, 729 bp, Homo sapiens
  Payload ID: 6998
  Gene Symbol: GSTZ1
  Gene Name: glutathione S-transferase zeta 1
  ENST ID: ENST00000554381
  CDS Start-End: 1-213
gtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgagagtcgcagtggacacacccagtccagccactgactctggggtatgcaccctgatgggaacccaccgggacctctttcaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaa

SEQ ID NO: 137860 - DNA, 873 bp, Homo sapiens
  Payload ID: 6998
  Gene Symbol: GSTZ1
  Gene Name: glutathione S-transferase zeta 1
  Uniprot ID: O43708
  ENST ID: ENST00000557639
  CDS Start-End: 263-748
gaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagatgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgcctt

SEQ ID NO: 137861 - DNA, 979 bp, Homo sapiens
  Payload ID: 6998
  Gene Symbol: GSTZ1
  Gene Name: glutathione S-transferase zeta 1
  ENST ID: ENST00000553586
  CDS Start-End: 37-690
gacatttcctgggaggctgagggtcaccacgataccatgacagagtctggcaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagatgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcacc

SEQ ID NO: 137862 - DNA, 564 bp, Homo sapiens
  Payload ID: 6998
  Gene Symbol: GSTZ1
  Gene Name: glutathione S-transferase zeta 1
  ENST ID: ENST00000555583
  CDS Start-End: 451-564
acatttcctgggaggctgagggtcaccacgataccatgacagagtctggcaaggtatggaaggcactctcaggctagctgcccctttgggggcctcttggacctcaggagctcaaaccagcataattttggagccaagggacctcatgagcctctcagagagcttggagtctgccctgatttgcacagatgcaggcctgagagaggaggcctggcaggacaggaagaaatggttgactcctcccaagctggagcccacccagcatgggttaacacgcgccttcatcctctctctcctcagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagatgcgtcccactccgcgacttctgcctcaggaccca

SEQ ID NO: 137863 - DNA, 795 bp, Homo sapiens
  Payload ID: 6998
  Gene Symbol: GSTZ1
  Gene Name: glutathione S-transferase zeta 1
  ENST ID: ENST00000554279
  CDS Start-End: 155-763
gaggcgaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcagctggccatcattgagtatctagaggagatgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggcca

SEQ ID NO: 137864 - DNA, 714 bp, Homo sapiens
  Payload ID: 6998
  Gene Symbol: GSTZ1
  Gene Name: glutathione S-transferase zeta 1
  ENST ID: ENST00000554846
  CDS Start-End: 538-714
ccgggagggttgggccagaggaggcggtcctggtagggagtgcgtagcagggtggagtcgctgtccggtcgcgcttcacttctgctccgccctccctgctccccataacagacccctccctccactaaggcttccaaacgtcgccccaagcctcccaatttctcgcagcccttcatgctcttctcttggccctagcaggagtggtcaccagcagtccctgtcccttggcaccaggagtccctgtagcctggctaggtaaggaaagggagttgcatctccaaataaggaagatccagttgtggccacccaattcctcctcttcgaaagacactttctgcccatcacctgctttctgtgccaggaccatctttactttctccacaaaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagatgcgtcccactccgcgacttctgcctcaggacccaaagaagagggccagcgtgcgtatgatttctgacctcatcgctggtggcatccagcccctgcag

SEQ ID NO: 137865 - DNA, 2154 bp, Homo sapiens
  Payload ID: 6999
  Gene Symbol: GSTCD
  Gene Name: glutathione S-transferase, C-terminal domain containing
  Uniprot ID: Q8NEC7
  ENST ID: ENST00000360505
  CDS Start-End: 76-1977
aacagatgattccctgattctccagagagattacacacttcgtttgtggctaaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagacttgcttgaaagcctgtgctgaagttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaagctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaattatcagcaggaaattttctgagaagctggtagaatttccattgctagcctcttggtaccagaggattcaggaagtgccaggagtaaaaacagcagcttctaagtgtgggatccaatttctccatttaccaaagttgttgacaacctcaactgaacagcatccaaacttatgtgaagtcccaggtgtagaagagcaaagcgatcctttatttataggaggaccaagaccaaccatggccaagttaatggaaaagggcattgaagtgatgttttctccccacccttgccctacttggactcttgattggaatgttctccctgcagcagtcagcccaaaggaaggtaaaatgtccagtgatcgagctttgaggaagcagcaacagttgaacaaccttgtctatgtggtaacaaatcaggccaaacctggtgacagaattgtggatttctgcagcggtgggggccatgttggaattgtccttgctcacatgctgccatcatgtcaggttacattaatagaaaacaaggaattatcattaattcgtgctaagaagagaagtgatgaactgggtttaagcaacatttggttcattcaagcaaatatggaatattttactgggatgtttaatattggagtagcattgcatgcttgtggagtggcaacagacatggtgattgagcactgtatcaaaacacgggcttccttcgtcacatgcccttgctgttatggtttcattcagaacacctcaaagttcaattttccaaaaagtgaacaattcaagaaaactttatcatacaaggaacacatgattctgtgcagatttgcagaccagacagctgtccagctcccaccccaacgaaggctcataggaaaacagtgcatgtgcttggtggatctggatcgagcaagagctgcagaagaatgtggatactccgttcaagtgatatccatggagccagagagctgctctcccaaaaataacatgattgtgggagtccccatttaaaatgagatattcacatttgatattttgccatccgtcttcacgttggatgcccagtggcattcaggaggttcttggcataactaggaaacagcattagccatcttgaacctattgtgctcaggaaggaaagcaacagggaaatcttggaagtaaaggctccctgcaaagcatcacaaa

SEQ ID NO: 137866 - DNA, 2416 bp, Homo sapiens
  Payload ID: 6999
  Gene Symbol: GSTCD
  Gene Name: glutathione S-transferase, C-terminal domain containing
  Uniprot ID: Q8NEC7
  ENST ID: ENST00000394728
  CDS Start-End: 114-2015
gtgctgaagagccattggatggttttgagcacgagacatctgatttatgtttttaaggatcaccctgttgttggagaatggactgttttatggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagacttgcttgaaagcctgtgctgaagttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaagctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaattatcagcaggaaattttctgagaagctggtagaatttccattgctagcctcttggtaccagaggattcaggaagtgccaggagtaaaaacagcagcttctaagtgtgggatccaatttctccatttaccaaagttgttgacaacctcaactgaacagcatccaaacttatgtgaagtcccaggtgtagaagagcaaagcgatcctttatttataggaggaccaagaccaaccatggccaagttaatggaaaagggcattgaagtgatgttttctccccacccttgccctacttggactcttgattggaatgttctccctgcagcagtcagcccaaaggaaggtaaaatgtccagtgatcgagctttgaggaagcagcaacagttgaacaaccttgtctatgtggtaacaaatcaggccaaacctggtgacagaattgtggatttctgcagcggtgggggccatgttggaattgtccttgctcacatgctgccatcatgtcaggttacattaatagaaaacaaggaattatcattaattcgtgctaagaagagaagtgatgaactgggtttaagcaacatttggttcattcaagcaaatatggaatattttactgggatgtttaatattggagtagcattgcatgcttgtggagtggcaacagacatggtgattgagcactgtatcaaaacacgggcttccttcgtcacatgcccttgctgttatggtttcattcagaacacctcaaagttcaattttccaaaaagtgaacaattcaagaaaactttatcatacaaggaacacatgattctgtgcagatttgcagaccagacagctgtccagctcccaccccaacgaaggctcataggaaaacagtgcatgtgcttggtggatctggatcgagcaagagctgcagaagaatgtggatactccgttcaagtgatatccatggagccagagagctgctctcccaaaaataacatgattgtgggagtccccatttaaaatgagatattcacatttgatattttgccatccgtcttcacgttggatgcccagtggcattcaggaggttcttggcataactaggaaacagcattagccatcttgaacctattgtgctcaggaaggaaagcaacagggaaatcttggaagtaaaggctccctgcaaagcatcacaaatgctttacaatgtgtgattaaaggactgctggtttttatagtgagaatcccctgaagtctcagctgccaaaagaataatactagtggaggttccatcacaggaataacaatttccttctcacttcacaagctcctctgatcttgccaatgtgatgtttaattcaaaacagcgcacttacagcctttattttatacttatttagatattcacatgggaactgaaa

SEQ ID NO: 137867 - DNA, 4043 bp, Homo sapiens
  Payload ID: 6999
  Gene Symbol: GSTCD
  Gene Name: glutathione S-transferase, C-terminal domain containing
  Uniprot ID: Q8NEC7
  ENST ID: ENST00000394730
  CDS Start-End: 255-1895
gttacttccctttttccggtccgccggattatgaatgacggccggcgcgagtattttccacataaggtggctgtcgtttttctcctggcgtctgtggaggcgagtggtctgcgggcagcagctcccagaggcagccttggaattccagctcggactgggcgggaaggcgcaggcggcccaggtcgccgacacgctcacgcaccctccctgcctggccgcgcctctgcgaccaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaagctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaattatcagcaggaaattttctgagaagctggtagaatttccattgctagcctcttggtaccagaggattcaggaagtgccaggagtaaaaacagcagcttctaagtgtgggatccaatttctccatttaccaaagttgttgacaacctcaactgaacagcatccaaacttatgtgaagtcccaggtgtagaagagcaaagcgatcctttatttataggaggaccaagaccaaccatggccaagttaatggaaaagggcattgaagtgatgttttctccccacccttgccctacttggactcttgattggaatgttctccctgcagcagtcagcccaaaggaaggtaaaatgtccagtgatcgagctttgaggaagcagcaacagttgaacaaccttgtctatgtggtaacaaatcaggccaaacctggtgacagaattgtggatttctgcagcggtgggggccatgttggaattgtccttgctcacatgctgccatcatgtcaggttacattaatagaaaacaaggaattatcattaattcgtgctaagaagagaagtgatgaactgggtttaagcaacatttggttcattcaagcaaatatggaatattttactgggatgtttaatattggagtagcattgcatgcttgtggagtggcaacagacatggtgattgagcactgtatcaaaacacgggcttccttcgtcacatgcccttgctgttatggtttcattcagaacacctcaaagttcaattttccaaaaagtgaacaattcaagaaaactttatcatacaaggaacacatgattctgtgcagatttgcagaccagacagctgtccagctcccaccccaacgaaggctcataggaaaacagtgcatgtgcttggtggatctggatcgagcaagagctgcagaagaatgtggatactccgttcaagtgatatccatggagccagagagctgctctcccaaaaataacatgattgtgggagtccccatttaaaatgagatattcacatttgatattttgccatccgtcttcacgttggatgcccagtggcattcaggaggttcttggcataactaggaaacagcattagccatcttgaacctattgtgctcaggaaggaaagcaacagggaaatcttggaagtaaaggctccctgcaaagcatcacaaatgctttacaatgtgtgattaaaggactgctggtttttatagtgagaatcccctgaagtctcagctgccaaaagaataatactagtggaggttccatcacaggaataacaatttccttctcacttcacaagctcctctgatcttgccaatgtgatgtttaattcaaaacagcgcacttacagcctttattttatacttatttagatattcacatgggaactgaaagtagactcagtggagttttttgttttttatatttttaacaattgtactttttctatcactttaaaaaaatctagtcaggtaattatagtacagttatttttaagctggggttagttgaacttgtatagcatttaatatactccttttaaatatatttctgccaggcatggtggctcatgcctataatcccagcactttgagaggccaaggtgggaggatcatttgagcccaggatatcgagaccagcctgcactacaaaaaaatccaaaaaatgaggtgggaggatcacttgagcccaggaagtcaaggctgcagtgagccttgatagcgccactgcactcctgcctgggaaaatgagacccagactcaaaataaatcaatgaatgaattaataaacaaataaataaataaataaatttcccataaattaccaaatgagattgtcactggttcaaattattaaataattgccataaatttcctattacgggaatgtggaatttggacatacattttaacaataagtacattgattaatacatttaagtttataagtaattattgaggatccagtattttcaagaccttggcctagtttcttttcaattcaaagatgagttgcaaaagacataatgttttgcctatggaagtagatcatctagaagaaaaagattaaagaattagttaagcttttttttttttttttttttgagacagagtttcactcttgttgcccaggctggaattcagtggctcgatcttggctcaccacaacctctgcattctcctgcctcagcctcccgagtagctaggattataggcacctgccaccatgcccggctaattttgtttgtaattttagtagagatggggtttctccatgttggccaggctggtttcgaactcctgacctcaggtgatctacccgcctcagcctcccaaagtgctgaaattacaggcgtgagccacctcacctggccatgttctttatggaatactacaatgtgttgtcacaggatttgttattcagatgtcaatcatttttatttatatatttctgggtaaaacttattagtggtgtgaggagtgcagaatatggaagcttacctaaattctttttctgccagccaacattttaaaagacaaatgatgcatcctttctcaatgctgctaattctttaaattttacatgtcccaatttattccatttgagatttattttaatgttttcaacccctgtgtaacatgtatcatgaggagaaagcactatcattgatcatcactatggattaaaatataggaatattttacagggcagtatgggtgggggtgggagacatattggaatcgtgttttctgggataaaatttttaaaaagaattaatcattagccctgagtattttagtcatttgtgcctatagaaaacaacatgctcttttattgtggactttcttcttttaagtgaggtttaatttatatacaatacaataacagatttttaagtattcatttgagatgttttgacaactgtatatatacatgtaaccatcactggaatcagatatagaatattccccttaaatattgtcaggtaaacacattgagaatattttttccagtctgtggcttacctacttattttcataatgaatgttttacttgtgatgaagatttaacttacccttttactttaatgattaatattttctgtgttctttctaataaattttacgaactctgaggtta

SEQ ID NO: 137868 - DNA, 4273 bp, Homo sapiens
  Payload ID: 6999
  Gene Symbol: GSTCD
  Gene Name: glutathione S-transferase, C-terminal domain containing
  Uniprot ID: Q8NEC7
  ENST ID: ENST00000515279
  CDS Start-End: 221-2122
atgacggccggcgcgagtattttccacataaggtggctgtcgtttttctcctggcgtctgtggaggcgagtggtctgcgggcagcagctcccagaggcagccttggaattccagctcggactgggcgggaaggcgcaggcggcccaggtcgccgacacgctcacgcaccctccctgcctggccgcgcctctgcgaccaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagacttgcttgaaagcctgtgctgaagttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaagctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaattatcagcaggaaattttctgagaagctggtagaatttccattgctagcctcttggtaccagaggattcaggaagtgccaggagtaaaaacagcagcttctaagtgtgggatccaatttctccatttaccaaagttgttgacaacctcaactgaacagcatccaaacttatgtgaagtcccaggtgtagaagagcaaagcgatcctttatttataggaggaccaagaccaaccatggccaagttaatggaaaagggcattgaagtgatgttttctccccacccttgccctacttggactcttgattggaatgttctccctgcagcagtcagcccaaaggaaggtaaaatgtccagtgatcgagctttgaggaagcagcaacagttgaacaaccttgtctatgtggtaacaaatcaggccaaacctggtgacagaattgtggatttctgcagcggtgggggccatgttggaattgtccttgctcacatgctgccatcatgtcaggttacattaatagaaaacaaggaattatcattaattcgtgctaagaagagaagtgatgaactgggtttaagcaacatttggttcattcaagcaaatatggaatattttactgggatgtttaatattggagtagcattgcatgcttgtggagtggcaacagacatggtgattgagcactgtatcaaaacacgggcttccttcgtcacatgcccttgctgttatggtttcattcagaacacctcaaagttcaattttccaaaaagtgaacaattcaagaaaactttatcatacaaggaacacatgattctgtgcagatttgcagaccagacagctgtccagctcccaccccaacgaaggctcataggaaaacagtgcatgtgcttggtggatctggatcgagcaagagctgcagaagaatgtggatactccgttcaagtgatatccatggagccagagagctgctctcccaaaaataacatgattgtgggagtccccatttaaaatgagatattcacatttgatattttgccatccgtcttcacgttggatgcccagtggcattcaggaggttcttggcataactaggaaacagcattagccatcttgaacctattgtgctcaggaaggaaagcaacagggaaatcttggaagtaaaggctccctgcaaagcatcacaaatgctttacaatgtgtgattaaaggactgctggtttttatagtgagaatcccctgaagtctcagctgccaaaagaataatactagtggaggttccatcacaggaataacaatttccttctcacttcacaagctcctctgatcttgccaatgtgatgtttaattcaaaacagcgcacttacagcctttattttatacttatttagatattcacatgggaactgaaagtagactcagtggagttttttgttttttatatttttaacaattgtactttttctatcactttaaaaaaatctagtcaggtaattatagtacagttatttttaagctggggttagttgaacttgtatagcatttaatatactccttttaaatatatttctgccaggcatggtggctcatgcctataatcccagcactttgagaggccaaggtgggaggatcatttgagcccaggatatcgagaccagcctgcactacaaaaaaatccaaaaaatgaggtgggaggatcacttgagcccaggaagtcaaggctgcagtgagccttgatagcgccactgcactcctgcctgggaaaatgagacccagactcaaaataaatcaatgaatgaattaataaacaaataaataaataaataaatttcccataaattaccaaatgagattgtcactggttcaaattattaaataattgccataaatttcctattacgggaatgtggaatttggacatacattttaacaataagtacattgattaatacatttaagtttataagtaattattgaggatccagtattttcaagaccttggcctagtttcttttcaattcaaagatgagttgcaaaagacataatgttttgcctatggaagtagatcatctagaagaaaaagattaaagaattagttaagcttttttttttttttttttttgagacagagtttcactcttgttgcccaggctggaattcagtggctcgatcttggctcaccacaacctctgcattctcctgcctcagcctcccgagtagctaggattataggcacctgccaccatgcccggctaattttgtttgtaattttagtagagatggggtttctccatgttggccaggctggtttcgaactcctgacctcaggtgatctacccgcctcagcctcccaaagtgctgaaattacaggcgtgagccacctcacctggccatgttctttatggaatactacaatgtgttgtcacaggatttgttattcagatgtcaatcatttttatttatatatttctgggtaaaacttattagtggtgtgaggagtgcagaatatggaagcttacctaaattctttttctgccagccaacattttaaaagacaaatgatgcatcctttctcaatgctgctaattctttaaattttacatgtcccaatttattccatttgagatttattttaatgttttcaacccctgtgtaacatgtatcatgaggagaaagcactatcattgatcatcactatggattaaaatataggaatattttacagggcagtatgggtgggggtgggagacatattggaatcgtgttttctgggataaaatttttaaaaagaattaatcattagccctgagtattttagtcatttgtgcctatagaaaacaacatgctcttttattgtggactttcttcttttaagtgaggtttaatttatatacaatacaataacagatttttaagtattcatttgagatgttttgacaactgtatatatacatgtaaccatcactggaatcagatatagaatattccccttaaatattgtcaggtaaacacattgagaatattttttccagtctgtggcttacctacttattttcataatgaatgttttacttgtgatgaagatttaacttacccttttactttaatgattaatattttctgtgttctttctaataaattttacgaactctgaggttataa

SEQ ID NO: 137869 - DNA, 2091 bp, Homo sapiens
  Payload ID: 6999
  Gene Symbol: GSTCD
  Gene Name: glutathione S-transferase, C-terminal domain containing
  ENST ID: ENST00000507281
  CDS Start-End: 252-1274
acttccctttttccggtccgccggattatgaatgacggccggcgcgagtattttccacataaggtggctgtcgtttttctcctggcgtctgtggaggcgagtggtctgcgggcagcagctcccagaggcagccttggaattccagctcggactgggcgggaaggcgcaggcggcccaggtcgccgacacgctcacgcaccctccctgcctggccgcgcctctgcgaccaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaagctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaattatcagcaggaaattttctgagaagctggtagaatttccattgctagcctcttggtaccagaggattcaggaagtgccaggagtaaaaacagcagcttctaagtgtgggatccaatttctccatttaccaaagttgttgacaacctcaactgaacagcatccaaacttatgtgaagtcccaggtgtagaagagcaaagcgatcctttatttataggaggaccaagaccaaccatggccaagttaatggaaaagggcattgaagtgatgttttctccccacccttgccctacttggactcttgattggaatgttctccctgcagcagtcagcccaaaggaagatggagtcttgctctgtcactcaggctggaatgcagtggtgtagtctcggctcactggaaccccagcctcccgggttcaagtaattctgctgcttcagcctcccaagtagctgggattataggagcccgccaccatatctggctaatttttgtatttttagtaaatatgaagtttcaccatattggccaggctggtctcgaactcctgacctcaagtgatccagccgcctcagcctcccaaagtgccaggattataggcttcagccaccactcggactcaatatgcttttaaatgtaattttctaaaaacagcttttggagagaacagaggcatcaatactgttacagtctattagttatctggccctatggacattagtaagtaacattctagagtatgagtgtcagagaccagtggtttgtctattaaaatagtagaattatcttacttgataattcttgagaaggctgtgactcagtttactaaatttactatatttattaaatataaagcaatgtttggctccttgattctgcacacctttatttgactctgcctgttttctttcacataaggactacagcattttttactgactcctccttgaccatcatttttttcataatataataaaaacctggcatttccgtgaagttgacttactggcttgtattgctatttacttctgggatgtagtaatatagggatatactatggaaagaaacttaacaaaaaacagagaaaattatctgtagttgtcaagggctcattaacctttctgtgccttaaatcgaagccacatttttgtgtctgtgtagcttgtcatcctcaataaaatctgcttgaatttgaaaattcta

SEQ ID NO: 137870 - DNA, 572 bp, Homo sapiens
  Payload ID: 6999
  Gene Symbol: GSTCD
  Gene Name: glutathione S-transferase, C-terminal domain containing
  ENST ID: ENST00000512828
  CDS Start-End: 451-572
agtgacgttacttccctttttccggtccgccggattatgaatgacggccggcgcgagtattttccacataaggtggctgtcgtttttctcctggcgtctgtggaggcgagtggtctgcgggcagcagctcccagaggcagccttggaattccagctcggactgggcgggaaggcgcaggcggcccaggtcgccgacacgctcacgcaccctccctgcctggccgcgcctctgcgaccaggtaaagagggcgctcgggccgccggcttctcagcctccgcgaccccctaagaactggtcttttcttcgggggtctgcagggctgaggatgcgggggaagggtgggaaggacaagggcgtggtatcatcgtcctgatttttctcccgccctggggccgcctcaaactcctttttggccactcctgctgaaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactg

SEQ ID NO: 137871 - DNA, 718 bp, Homo sapiens
  Payload ID: 6999
  Gene Symbol: GSTCD
  Gene Name: glutathione S-transferase, C-terminal domain containing
  ENST ID: ENST00000509336
  CDS Start-End: 217-718
acttcgtttgtggctaaggttactgtaagcttttcacttaaaaacttttcctacttctttaccagataagaaaacagctaattttaatcactggcttttgttctctaggacttaactgcatcccatattacgtatttaatgagcttgaaaaaatctcagtgtttttcttatcgtttttgaccctaaatatttaaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagacttgcttgaaagcctgtgctgaagttagtcagtggaccaggctatgtgaactcaccatccctttggctattgagaattttctcagagaatcttctgacc

SEQ ID NO: 137872 - DNA, 578 bp, Homo sapiens
  Payload ID: 6999
  Gene Symbol: GSTCD
  Gene Name: glutathione S-transferase, C-terminal domain containing
  ENST ID: ENST00000510865
  CDS Start-End: 79-578
agatgattccctgattctccagagagattacacacttcgtttgtggctaaggttactgtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagacttgcttgaaagcctgtgctgaagttagtcagtggaccaggctatgtgaactcaccatccctttggctattgagaattttctcagagaatcttctga

SEQ ID NO: 137873 - DNA, 1922 bp, Homo sapiens
  Payload ID: 7000
  Gene Symbol: GSS
  Gene Name: glutathione synthetase
  Uniprot ID: P48637
  ENST ID: ENST00000216951
  CDS Start-End: 100-1524
aagcgcactgggtcgcatcgaggccccgccccctgagcctgggtagcggcgcgagggccgggagaaccgttcgcggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattcagtg

SEQ ID NO: 137874 - DNA, 1092 bp, Homo sapiens
  Payload ID: 7000
  Gene Symbol: GSS
  Gene Name: glutathione synthetase
  Uniprot ID: P48637
  ENST ID: ENST00000451957
  CDS Start-End: 1-1092
atggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagtgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtga

SEQ ID NO: 137875 - DNA, 1875 bp, Homo sapiens
  Payload ID: 7001
  Gene Symbol: GAPDH
  Gene Name: glyceraldehyde-3-phosphate dehydrogenase
  Uniprot ID: P04406
  ENST ID: ENST00000229239
  CDS Start-End: 667-1674
gggggaagtgggggctgggaaggaaccacgggcccccgcccgaggcccatgggcccctcctaggcctttgcctgagcagtccggtgtcactaccgcagagcctcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaacca

SEQ ID NO: 137876 - DNA, 1266 bp, Homo sapiens
  Payload ID: 7001
  Gene Symbol: GAPDH
  Gene Name: glyceraldehyde-3-phosphate dehydrogenase
  ENST ID: ENST00000396856
  CDS Start-End: 314-1096
tgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagtgagtggaagacagaatggaagaaatgcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatg

SEQ ID NO: 137877 - DNA, 1292 bp, Homo sapiens
  Payload ID: 7001
  Gene Symbol: GAPDH
  Gene Name: glyceraldehyde-3-phosphate dehydrogenase
  Uniprot ID: P04406
  ENST ID: ENST00000396858
  CDS Start-End: 266-1147
tgcaaccgggaaggaaatgaatgggcagccgttaggaaagcctgccggtgactaaccctgcgctcctgcctcgatgggtggagtcgcgtgtggcggggaagtcaggtggagcgaggctagctggcccgatttctcctccgggtgatgcttttcctagattattctctgatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggg

SEQ ID NO: 137878 - DNA, 1256 bp, Homo sapiens
  Payload ID: 7001
  Gene Symbol: GAPDH
  Gene Name: glyceraldehyde-3-phosphate dehydrogenase
  Uniprot ID: P04406
  ENST ID: ENST00000396859
  CDS Start-End: 80-1087
aggcgtgtgtgtcggccggggccactaggcgctcactgttctctccctccgcgcagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcat

SEQ ID NO: 137879 - DNA, 1348 bp, Homo sapiens
  Payload ID: 7001
  Gene Symbol: GAPDH
  Gene Name: glyceraldehyde-3-phosphate dehydrogenase
  Uniprot ID: P04406
  ENST ID: ENST00000396861
  CDS Start-End: 152-1159
ttcgacagtcagccgcatcttcttttgcgtcgccaggtgaagacgggcggagagaaacccgggaggctagggacggcctgaaggcggcaggggcgggcgcaggccggatgtgttcgcgccgctgcgggccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccc

SEQ ID NO: 137880 - DNA, 1086 bp, Homo sapiens
  Payload ID: 7001
  Gene Symbol: GAPDH
  Gene Name: glyceraldehyde-3-phosphate dehydrogenase
  Uniprot ID: P04406
  ENST ID: ENST00000619601
  CDS Start-End: 1-882
atggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccagtt

SEQ ID NO: 137881 - DNA, 1489 bp, Homo sapiens
  Payload ID: 7002
  Gene Symbol: GAPDHS
  Gene Name: glyceraldehyde-3-phosphate dehydrogenase, spermatogenic
  Uniprot ID: O14556
  ENST ID: ENST00000222286
  CDS Start-End: 117-1343
gtcactgggtgctgtgacatcagggcaattagcccaggacccacagccctggcgctccgcacgcacctcggtaacatcacagcaggtccaggccaatgataaccttataagaggccatgtcgaagcgcgacatcgtcctcaccaatgtcaccgttgtccagttgctgcgacagccgtgcccggtgaccagagcaccgcccccacctgagcctaaggctgaagtagagccccagccacaaccagagcccacaccagtcagggaggaaataaagccaccaccgccaccactgcctcctcaccccgctactcctcctcctaagatggtgtctgtggcccgggagctgactgtgggcatcaatggatttggacgcatcggtcgcctggtcctgcgcgcctgcatggagaagggtgttaaggtggtggctgtgaatgatccattcattgacccggaatacatggtgtacatgtttaagtatgactccacccacggccgatacaagggaagtgtggaattcaggaatggacaactggtcgtggacaaccatgagatctctgtctaccagtgcaaagagcccaaacagatcccctggagggctgtcgggagcccctacgtggtggagtccacaggcgtgtacctctccatacaggcagcttcggaccacatctctgcaggtgctcaacgtgtggtcatctccgcgccctcaccggatgcaccaatgttcgtcatgggtgtcaatgaaaatgactataaccctggctccatgaacattgtgagcaacgcgtcctgcaccaccaactgtttggctcccctcgccaaagtcatccacgagcgatttgggatcgtggaagggttgatgaccacagtccattcctacacggccacccagaagacagtggacgggccatcaaggaaggcctggcgagatgggcggggtgcccaccagaacatcatcccagcctccactggggctgcgaaagctgtgaccaaagtcatcccagagctcaaagggaagctgacagggatggcgttccgggtaccaaccccggatgtgtctgtcgtggacctgacctgccgcctcgcccagcctgccccctactcagccatcaaggaggctgtaaaagcagcagccaaggggcccatggctggcatccttgcctacaccgaggatgaggtcgtctctacggacttcctcggtgatacccactcgtccatcttcgatgctaaggccggcattgcgctcaatgacaatttcgtgaagctcatttcatggtacgacaacgaatatggctacagtcaccgggtggtcgacctcctccgctacatgttcagccgagacaagtgaaacgggaaggtcctttctttccttcccaggggccggggccggaacatgtgcctcccgttccagcatctggctgcccgggggaggaaggacacccggggcgggcgccccacgccgatgggtccatggtgaaataaaaaacagtgctc

SEQ ID NO: 137882 - DNA, 599 bp, Homo sapiens
  Payload ID: 7002
  Gene Symbol: GAPDHS
  Gene Name: glyceraldehyde-3-phosphate dehydrogenase, spermatogenic
  ENST ID: ENST00000586334
  CDS Start-End: 74-208
cagccctggcgctccgcacgcacctcggtaacatcacagcaggtccaggccaatgataaccttataagaggccatgtcgaagcgcgacatcgtcctcaccaatgtcaccgttgtccagttgctgcgacagccgtgcccggatttggacgcatcggtcgcctggtcctgcgcgcctgcatggagaagggtgttaaggtggtggctgtgaatgatccattcattgacccggaatacatggtgtacatgtttaagtatgactccacccacggccgatacaagggaagtgtggaattcaggaatggacaactggtcgtggacaaccatgagatctctgtctaccagtgcaaagagcccaaacagatcccctggagggctgtcgggagcccctacgtggtggagtccacaggcgtgtacctctccatacaggcagcttcggaccacatctctgcaggtgctcaacgtgtggtcatctccgcgccctcaccggatgcaccaatgttcgtcatgggtgtcaatgaaaatgactataaccctggctccatgaacattgtgagcaacgcgtcctgcaccaccaactgtttggctcccctcgccaaagt

SEQ ID NO: 137883 - DNA, 704 bp, Homo sapiens
  Payload ID: 7002
  Gene Symbol: GAPDHS
  Gene Name: glyceraldehyde-3-phosphate dehydrogenase, spermatogenic
  ENST ID: ENST00000585510
  CDS Start-End: 168-704
gcaacccattccctcccttcccccgcatagtgaccagagcaccgcccccacctgagcctaaggctgaagtagagccccagccacaaccagagcccacaccagtcagggaggaaataaagccaccaccgccaccactgcctcctcaccccgctactcctcctcctaagatggtgtctgtggcccgggagctgactgtgggcatcaatggatttggacgcatcggtcgcctggtcctgcgcgcctgcatggagaagggtgttaaggtggtggctgtgaatgatccattcattgacccggaatacatggtgtacatgtttaagtatgactccacccacggccgatacaagggaagtgtggaattcaggaatggacaactggtcgtggacaaccatgagatctctgtctaccagtgcaaagagcccaaacagatcccctggagggctgtcgggagcccctacgtggtggagtccacaggcgtgtacctctccatacaggcagcttcggaccacatctctgcaggtgctcaacgtgtggtcatctccgcgccctcaccggatgcaccaatgttcgtcatgggtgtcaatgaaaatgactataaccctggctccatgaacattgtgagcaacgcgtcctgcaccaccaactgtttggctcccctcgccaaagtcatccacgagcgatttgggatcgtggaagggttgatg

SEQ ID NO: 137884 - DNA, 1371 bp, Homo sapiens
  Payload ID: 7003
  Gene Symbol: GLYCTK
  Gene Name: glycerate kinase
  Uniprot ID: Q8IVS8
  ENST ID: ENST00000305690
  CDS Start-End: 97-801
caccccctagtacttccgttctccagcgctgggcaccgcggccggagctgtgggctggcagccatgggtgccaggcagtgctgagagcagtggggcatggctgcagccctgcaggtcctgccccgcttggcccgagcccccttgcatccactcctctggcggggctcagtggcccgtctggccagcagcatggccttggcagagcaggccaggcagctgtttgagagtgctgtaggtgcagtgctgccgggccccatgctgcaccgggcactatccttggaccctggtggcagacagctgaaggtgcgggaccggaactttcagctgaggcaaaacctctacctggtgggctttggcaaggctgtgctgggtatggcagctgcagctgaggaactactgggccagcatcttgtgcagggcgtgatcagcgttcccaaggggatccgtgctgccatggagcgtgccggcaagcaggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaaggtgatgtaaaaagtatggcccagttctacgggctgctggcccatgtggctagaacccgcctcaccccatccatggctggggcttctgtggaggaagatgcacagctccatgagctggcagctgagcttcagatcccagacctgcagctggaggaggctctggagaccatggcatggggaaggggcccagtctgcctgctggctggtggcgagcccacagtacagctgcagggctcgggcaggggtggccggaaccaggaactggccctgcgtgttggagcagagttgagaaggtggccgctggggccgatagatgtgctgtttttgagcggtggcaccgatgggcaggatgggcccacagaggctgctggggcctgggtcacacctgagcttgccagccaggctgcagctgagggcctggacatagccaccttcct

SEQ ID NO: 137885 - DNA, 1982 bp, Homo sapiens
  Payload ID: 7003
  Gene Symbol: GLYCTK
  Gene Name: glycerate kinase
  Uniprot ID: Q8IVS8
  ENST ID: ENST00000436784
  CDS Start-End: 61-1632
cgcggccggagctgtgggctggcagccatgggtgccaggcagtgctgagagcagtggggcatggctgcagccctgcaggtcctgccccgcttggcccgagcccccttgcatccactcctctggcggggctcagtggcccgtctggccagcagcatggccttggcagagcaggccaggcagctgtttgagagtgctgtaggtgcagtgctgccgggccccatgctgcaccgggcactatccttggaccctggtggcagacagctgaaggtgcgggaccggaactttcagctgaggcaaaacctctacctggtgggctttggcaaggctgtgctgggtatggcagctgcagctgaggaactactgggccagcatcttgtgcagggcgtgatcagcgttcccaaggggatccgtgctgccatggagcgtgccggcaagcaggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcaggtgggggttcagctctgctgcctgcccccatcccacctgtcacactggaggagaagcagacactcactagactgctggcagcccgtggagccaccatccaggagttgaacaccattcggaaggccctgtcccagctcaagggtggggggctggctcaggccgcctaccctgcccaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaaggtgatgtaaaaagtatggcccagttctacgggctgctggcccatgtggctagaacccgcctcaccccatccatggctggggcttctgtggaggaagatgcacagctccatgagctggcagctgagcttcagatcccagacctgcagctggaggaggctctggagaccatggcatggggaaggggcccagtctgcctgctggctggtggcgagcccacagtacagctgcagggctcgggcaggggtggccggaaccaggaactggccctgcgtgttggagcagagttgagaaggtggccgctggggccgatagatgtgctgtttttgagcggtggcaccgatgggcaggatgggcccacagaggctgctggggcctgggtcacacctgagcttgccagccaggctgcagctgagggcctggacatagccaccttcctagcccacaatgactcacataccttcttctgctgcctccagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaaggttggtcctcagggcctctctaagccttagggcccctcctctccttggccttggctgtttggttaactgtcaccttccactcagggcctctgctctatatctattcccttccagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgccatgggt

SEQ ID NO: 137886 - DNA, 889 bp, Homo sapiens
  Payload ID: 7003
  Gene Symbol: GLYCTK
  Gene Name: glycerate kinase
  ENST ID: ENST00000461183
  CDS Start-End: 6-857
gcagaatggaactcttgctaagccagagctgtatttggtggcccatggtgggagagggaagaacaataataagttgtggaataaaagccatggagaggagcgggaattacttaatctggctccagaagggggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcaggtgggggttcagctctgctgcctgcccccatcccacctgtcacactggaggagaagcagacactcactagactgctggcagcccgtggagccaccatccaggagttgaacaccattcggaaggccctgtcccagctcaagggtggggggctggctcaggccgcctaccctgcccaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaagggtggggcacacctgctgcacacagggatgacaggtaccaatgtcatggacacccacctcttgttcctgcggcctcggtgatggcataggtcacattttgggagttcagaggaggcctaca

SEQ ID NO: 137887 - DNA, 992 bp, Homo sapiens
  Payload ID: 7003
  Gene Symbol: GLYCTK
  Gene Name: glycerate kinase
  ENST ID: ENST00000471180
  CDS Start-End: 47-769
ccgttctccagcgctgggcaccgcggccggagctgtgggctgggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcaggtgggggttcagctctgctgcctgcccccatcccacctgtcacactggaggagaagcagacactcactagactgctggcagcccgtggagccaccatccaggagttgaacaccattcggaaggccctgtcccagctcaagggtggggggctggctcaggccgcctaccctgcccaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgcca

SEQ ID NO: 137888 - DNA, 935 bp, Homo sapiens
  Payload ID: 7003
  Gene Symbol: GLYCTK
  Gene Name: glycerate kinase
  Uniprot ID: Q8IVS8
  ENST ID: ENST00000473032
  CDS Start-End: 97-714
caccccctagtacttccgttctccagcgctgggcaccgcggccggagctgtgggctggcagccatgggtgccaggcagtgctgagagcagtggggcatggctgcagccctgcaggtcctgccccgcttggcccgagcccccttgcatccactcctctggcggggctcagtggcccgtctggccagcagcatggccttggcagagcaggccaggcagctgtttgagagtgctgtaggtgcagtgctgccgggccccatgctgcaccgggcactatccttggaccctggtggcagacagctgaaggtgcgggaccggaactttcagctgaggcaaaacctctacctggtgggctttggcaaggctgtgctgggtatggcagctgcagctgaggaactactgggccagcatcttgtgcagggcgtgatcagcgttcccaaggggatccgtgctgccatggagcgtgccggcaagcaggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgc

SEQ ID NO: 137889 - DNA, 1304 bp, Homo sapiens
  Payload ID: 7003
  Gene Symbol: GLYCTK
  Gene Name: glycerate kinase
  Uniprot ID: Q8IVS8
  ENST ID: ENST00000477382
  CDS Start-End: 30-734
gtgccaggcagtgctgagagcagtggggcatggctgcagccctgcaggtcctgccccgcttggcccgagcccccttgcatccactcctctggcggggctcagtggcccgtctggccagcagcatggccttggcagagcaggccaggcagctgtttgagagtgctgtaggtgcagtgctgccgggccccatgctgcaccgggcactatccttggaccctggtggcagacagctgaaggtgcgggaccggaactttcagctgaggcaaaacctctacctggtgggctttggcaaggctgtgctgggtatggcagctgcagctgaggaactactgggccagcatcttgtgcagggcgtgatcagcgttcccaaggggatccgtgctgccatggagcgtgccggcaagcaggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaaggtgatgtaaaaagtatggcccagttctacgggctgctggcccatgtggctagaacccgcctcaccccatccatggctggggcttctgtggaggaagatgcacagctccatgagctggcagctgagcttcagatcccagacctgcagctggaggaggctctggagaccatggcatggggaaggggcccagtctgcctgctggctggtggcgagcccacagtacagctgcagggctcgggcaggggtggccggaaccaggaactggccctgcgtgttggagcagagttgagaaggtggccgctggggccgatagatgtgctgtttttgagcggtggcaccgatgggcaggatgggcccacagaggctgctggggcctgggtcacacctgagcttgccagccaggctgcagctgagggcctggacatagccaccttcct

SEQ ID NO: 137890 - DNA, 2019 bp, Homo sapiens
  Payload ID: 7003
  Gene Symbol: GLYCTK
  Gene Name: glycerate kinase
  ENST ID: ENST00000486393
  CDS Start-End: 97-735
caccccctagtacttccgttctccagcgctgggcaccgcggccggagctgtgggctggcagccatgggtgccaggcagtgctgagagcagtggggcatggctgcagccctgcaggtcctgccccgcttggcccgagcccccttgcatccactcctctggcggggctcagtggcccgtctggccagcagcatggccttggcagagcaggccaggcagctgtttgagagtgctgtaggtgcagtgctgccgggccccatgctgcaccgggcactatccttggaccctggtggcagacagctgaaggtgcgggaccggaactttcagctgaggcaaaacctctacctggtgggctttggcaaggctgtgctgggtatggcagctgcagctgaggaactactgggccagcatcttgtgcagggcgtgatcagcgttcccaaggggatccgtgctgccatggagcgtgccggcaagcaggagatgctgctgaagccacatagccgtgtccaggtattcgagggtgcggaggacaacctcccggaccgcgatgcgctgcgggctgcactggccatccagcaactggctgagggactcacagctgatgacctgctgctcgtgctgatctcagaggtgggggttcagctctgctgcctgcccccatcccacctgtcacactggaggagaagcagacactcactagactgctggcagcccgtggagccaccatccaggagttgaacaccattcggaaggccctgtcccagctcaagggtggggggctggctcaggccgcctaccctgcccaggtggtgagcctcatcctgtcagatgtggtgggggaccctgtggaggtgattgccagtggccccaccgtggccagttcccacaatgtgcaagattgcctgcatatcctcaatcgctacggcctccgtgcagccctgccacgttctgtgaagactgtgctgtctcgggccgactctgacccccatgggccacacacctgtggccatgtcctgaatgtgatcattggctctaatgtgctggcgctagctgaggcccagcggcaggccgaggcactgggctaccaggctgtggtgctgagtgcagccatgcaaggtgatgtaaaaagtatggcccagttctacgggctgctggcccatgtggctagaacccgcctcaccccatccatggctggggcttctgtggaggaagatgcacagctccatgagctggcagctgagcttcagatcccagacctgcagctggaggaggctctggagaccatggcatggggaaggggcccagtctgcctgctggctggtggcgagcccacagtacagctgcagggctcgggcaggggtggccggaaccaggaactggccctgcgtgttggagcagagttgagaaggtggccgctggggccgatagatgtgctgtttttgagcggtggcaccgatgggcaggatgggcccacagaggctgctggggcctgggtcacacctgagcttgccagccaggctgcagctgagggcctggacatagccaccttcctagcccacaatgactcacataccttcttctgctgcctccagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaaggttggtcctcagggcctctctaagccttagggcccctcctctccttggccttggctgtttggttaactgtcaccttccactcagggcctctgctctatatctattcccttccagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgccatggg

SEQ ID NO: 137891 - DNA, 464 bp, Homo sapiens
  Payload ID: 7004
  Gene Symbol: GK
  Gene Name: glycerol kinase
  ENST ID: ENST00000378938
  CDS Start-End: 1-285
aagattttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggagggtacatttaaagaatgaaatgttcagtgatatactgtgaaaacgaccttagtgcacgggagttttgtttttctgtttagttaaaagttaaggaaccaagtaaaatagtaaatgttatcattgcagattcggctgccaagcatattgggctttactgaataaatgtgaatgagagaaatcgttgcttatcaaaagaa

SEQ ID NO: 137892 - DNA, 458 bp, Homo sapiens
  Payload ID: 7004
  Gene Symbol: GK
  Gene Name: glycerol kinase
  ENST ID: ENST00000378941
  CDS Start-End: 1-357
atggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggatgggtggaacaggaccctaaggaaattctacattctgtctatgagtgtatagagaaaacatgtgagaaacttggacagctcaatattgatatttccaacataaaagctattggtgtcagcaaccagagggaaaccactgtagtctgggacaagataactggagagcctctctacaatgctgtggattgtcttacaaatgagtgaatgtttgccaaattgttttataacccctgctgtttgtgacatctaaaagagatcttacctccttaccctcaaaaaattaaaattacgtgtgttcacagtca

SEQ ID NO: 137893 - DNA, 3707 bp, Homo sapiens
  Payload ID: 7004
  Gene Symbol: GK
  Gene Name: glycerol kinase
  Uniprot ID: P32189
  ENST ID: ENST00000378943
  CDS Start-End: 180-1841
gggccggaggggcggggtgagaaggctgcgcgcgggtaaaggggccgcctcgagcgcggtccgagcgttcagcggacgcgcgcggcctcgatctctggactcgtcacctgcccctccccctcccgccgccgtcacccaggaaaccggccgcaatcgccggccgacctgaagctggtttcatggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggatgggtggaacaggaccctaaggaaattctacattctgtctatgagtgtatagagaaaacatgtgagaaacttggacagctcaatattgatatttccaacataaaagctattggtgtcagcaaccagagggaaaccactgtagtctgggacaagataactggagagcctctctacaatgctgtggtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaatggaggtgtccactgtacagatgtaacaaatgcaagtaggactatgcttttcaacattcattctttggaatgggataaacaactctgcgaattttttggaattccaatggaaattcttccaaatgtccggagttcttctgagatctatggcctaatgaaagctggggccttggaaggtgtgccaatatctgggtgtttaggggaccagtctgctgcattggtgggacaaatgtgcttccagattggacaagccaaaaatacgtatggaacaggatgtttcttactatgtaatacaggccataagtgtgtattttctgatcatggccttctcaccacagtggcttacaaacttggcagagacaaaccagtatattatgctttggaaggttctgtagctatagctggtgctgttattcgctggctaagagacaatcttggaattataaagacctcagaagaaattgaaaaacttgctaaagaagtaggtacttcttatggctgctacttcgtcccagcattttcggggttatatgcaccttattgggagcccagcgcaagagggataatctgtggactcactcagttcaccaataaatgccatattgcttttgctgcattagaagctgtttgtttccaaactcgagagattttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggaggaaagtgaaattcgttattctacatggaagaaagctgtgatgaagtcaatgggttgggttacaactcaatctccagaaagtggtgaccctagtatcttctgtagtctgcccttgggcttttttatagtgagtagcatggtaatgttaatcggagcaaggtacatctcaggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatgtttgaatagaaacctctactaaattattaaaatagacatttagtgttctcacagcttggatatttttctgaaaagttatttgccaaaactgaaatccttcagatgttttccatggtcccactaattataatgactttctgtctggatcttataggaaaagatactttcttttttcttccatctttcctttttatattttttactttgtatgtataacatacatgcctatatattttatacactgagggtagcccatttataaattaagagcacattatattcagaaggttctaacagggctggtcttaagtgaaccactgtgtatataaatatgttggaaaacagctgtatacatttttgggcaacggttatgcataatatttaccaggagaatttttttcttaacaagccaacatttaaaatttatgttttatgtcaataaaagaaaatatactttattgtgacttcaactatatttcttatcccttacatttttatttaattgtcttagcttaaaaaaagaagaaactgtggaatactacagtaaatattgttttcaaacacaagcaataattcaaatagttatttttcttttgaattaattttagacatattttggatcctattgaggggataagaggatgtcaaaaaagttaaatacctaagtagaaaaaaatatagaaataaagccaagaatctctttcagttcaaatgttatcaattgttaataagaaattgctatctgggatgacagaattacctctgcttagtatctcattataactgaaagaaggtttatcattacaaataccttccaatgaaaccaagaatttctcaaaatatttaatgtcacatattataagaagttacctaatcctgcttcttaacatcaatttttaaaaatatcttaaaattactttgttttgtagtaaacagtgaagaaaagattgcctcctaattatttttttcaatgagtgctgaatgggaaaacatttatatcttactataaaaggttctgttttgtttggaatcaatggtagctttattgactgttctgattgtgctgtttctaatttattgaatctgctaggttttattgatgcagccaccacttaagtgacataaatattatagaaaggtactgtgaaatgatcactttgtggcaggggtacttttaaacataaatgtttctacaaaagtaggttgagttcattgtaaataattgtgaaagccactgttcaaataattttaagattacattaatttttctataaattggaagatttataaatgtttgaaattgtacacattgatatttaatgacaaatttacttaaaataaattgaccccttgttctta

SEQ ID NO: 137894 - DNA, 2063 bp, Homo sapiens
  Payload ID: 7004
  Gene Symbol: GK
  Gene Name: glycerol kinase
  Uniprot ID: P32189
  ENST ID: ENST00000378945
  CDS Start-End: 61-1635
ctcccgccgccgtcacccaggaaaccggccgcaatcgccggccgacctgaagctggtttcatggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggatgggtggaacaggaccctaaggaaattctacattctgtctatgagtgtatagagaaaacatgtgagaaacttggacagctcaatattgatatttccaacataaaagctattggtgtcagcaaccagagggaaaccactgtagtctgggacaagataactggagagcctctctacaatgctgtggtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaatggaggtgtccactgtacagatgtaacaaatgcaagtaggactatgcttttcaacattcattctttggaatgggataaacaactctgcgaattttttggaattccaatggaaattcttccaaatgtccggagttcttctgagatctatggcctaatgaaagctggggccttggaaggtgtgccaatatctgggtgtttaggggaccagtctgctgcattggtgggacaaatgtgcttccagattggacaagccaaaaatacgtatggaacaggatgtttcttactatgtaatacaggccataagtgtgtattttctgatcatggccttctcaccacagtggcttacaaacttggcagagacaaaccagtatattatgctttggaaggttctgtagctatagctggtgctgttattcgctggctaagagacaatcttggaattataaagacctcagaagaaattgaaaaacttgctaaagaagtaggtacttcttatggctgctacttcgtcccagcattttcggggttatatgcaccttattgggagcccagcgcaagagggataatctgtggactcactcagttcaccaataaatgccatattgcttttgctgcattagaagctgtttgtttccaaactcgagagattttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggaggaaagtgaaattcgttattctacatggaagaaagctgtgatgaagtcaatgggttgggttacaactcaatctccagaaagtggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatc

SEQ ID NO: 137895 - DNA, 3638 bp, Homo sapiens
  Payload ID: 7004
  Gene Symbol: GK
  Gene Name: glycerol kinase
  Uniprot ID: P32189
  ENST ID: ENST00000378946
  CDS Start-End: 180-1772
gggccggaggggcggggtgagaaggctgcgcgcgggtaaaggggccgcctcgagcgcggtccgagcgttcagcggacgcgcgcggcctcgatctctggactcgtcacctgcccctccccctcccgccgccgtcacccaggaaaccggccgcaatcgccggccgacctgaagctggtttcatggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggatgggtggaacaggaccctaaggaaattctacattctgtctatgagtgtatagagaaaacatgtgagaaacttggacagctcaatattgatatttccaacataaaagctattggtgtcagcaaccagagggaaaccactgtagtctgggacaagataactggagagcctctctacaatgctgtggtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaatggaggtgtccactgtacagatgtaacaaatgcaagtaggactatgcttttcaacattcattctttggaatgggataaacaactctgcgaattttttggaattccaatggaaattcttccaaatgtccggagttcttctgagatctatggcctaatgaaaatctctcatagcgtgaaagctggggccttggaaggtgtgccaatatctgggtgtttaggggaccagtctgctgcattggtgggacaaatgtgcttccagattggacaagccaaaaatacgtatggaacaggatgtttcttactatgtaatacaggccataagtgtgtattttctgatcatggccttctcaccacagtggcttacaaacttggcagagacaaaccagtatattatgctttggaaggttctgtagctatagctggtgctgttattcgctggctaagagacaatcttggaattataaagacctcagaagaaattgaaaaacttgctaaagaagtaggtacttcttatggctgctacttcgtcccagcattttcggggttatatgcaccttattgggagcccagcgcaagagggataatctgtggactcactcagttcaccaataaatgccatattgcttttgctgcattagaagctgtttgtttccaaactcgagagattttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggaggaaagtgaaattcgttattctacatggaagaaagctgtgatgaagtcaatgggttgggttacaactcaatctccagaaagtggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatgtttgaatagaaacctctactaaattattaaaatagacatttagtgttctcacagcttggatatttttctgaaaagttatttgccaaaactgaaatccttcagatgttttccatggtcccactaattataatgactttctgtctggatcttataggaaaagatactttcttttttcttccatctttcctttttatattttttactttgtatgtataacatacatgcctatatattttatacactgagggtagcccatttataaattaagagcacattatattcagaaggttctaacagggctggtcttaagtgaaccactgtgtatataaatatgttggaaaacagctgtatacatttttgggcaacggttatgcataatatttaccaggagaatttttttcttaacaagccaacatttaaaatttatgttttatgtcaataaaagaaaatatactttattgtgacttcaactatatttcttatcccttacatttttatttaattgtcttagcttaaaaaaagaagaaactgtggaatactacagtaaatattgttttcaaacacaagcaataattcaaatagttatttttcttttgaattaattttagacatattttggatcctattgaggggataagaggatgtcaaaaaagttaaatacctaagtagaaaaaaatatagaaataaagccaagaatctctttcagttcaaatgttatcaattgttaataagaaattgctatctgggatgacagaattacctctgcttagtatctcattataactgaaagaaggtttatcattacaaataccttccaatgaaaccaagaatttctcaaaatatttaatgtcacatattataagaagttacctaatcctgcttcttaacatcaatttttaaaaatatcttaaaattactttgttttgtagtaaacagtgaagaaaagattgcctcctaattatttttttcaatgagtgctgaatgggaaaacatttatatcttactataaaaggttctgttttgtttggaatcaatggtagctttattgactgttctgattgtgctgtttctaatttattgaatctgctaggttttattgatgcagccaccacttaagtgacataaatattatagaaaggtactgtgaaatgatcactttgtggcaggggtacttttaaacataaatgtttctacaaaagtaggttgagttcattgtaaataattgtgaaagccactgttcaaataattttaagattacattaatttttctataaattggaagatttataaatgtttgaaattgtacacattgatatttaatgacaaatttacttaaaataaattgaccccttgttctta

SEQ ID NO: 137896 - DNA, 4573 bp, Homo sapiens
  Payload ID: 7004
  Gene Symbol: GK
  Gene Name: glycerol kinase
  Uniprot ID: P32189
  ENST ID: ENST00000427190
  CDS Start-End: 180-1859
gggccggaggggcggggtgagaaggctgcgcgcgggtaaaggggccgcctcgagcgcggtccgagcgttcagcggacgcgcgcggcctcgatctctggactcgtcacctgcccctccccctcccgccgccgtcacccaggaaaccggccgcaatcgccggccgacctgaagctggtttcatggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggatgggtggaacaggaccctaaggaaattctacattctgtctatgagtgtatagagaaaacatgtgagaaacttggacagctcaatattgatatttccaacataaaagctattggtgtcagcaaccagagggaaaccactgtagtctgggacaagataactggagagcctctctacaatgctgtggtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaatggaggtgtccactgtacagatgtaacaaatgcaagtaggactatgcttttcaacattcattctttggaatgggataaacaactctgcgaattttttggaattccaatggaaattcttccaaatgtccggagttcttctgagatctatggcctaatgaaaatctctcatagcgtgaaagctggggccttggaaggtgtgccaatatctgggtgtttaggggaccagtctgctgcattggtgggacaaatgtgcttccagattggacaagccaaaaatacgtatggaacaggatgtttcttactatgtaatacaggccataagtgtgtattttctgatcatggccttctcaccacagtggcttacaaacttggcagagacaaaccagtatattatgctttggaaggttctgtagctatagctggtgctgttattcgctggctaagagacaatcttggaattataaagacctcagaagaaattgaaaaacttgctaaagaagtaggtacttcttatggctgctacttcgtcccagcattttcggggttatatgcaccttattgggagcccagcgcaagagggataatctgtggactcactcagttcaccaataaatgccatattgcttttgctgcattagaagctgtttgtttccaaactcgagagattttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggaggaaagtgaaattcgttattctacatggaagaaagctgtgatgaagtcaatgggttgggttacaactcaatctccagaaagtggtgaccctagtatcttctgtagtctgcccttgggcttttttatagtgagtagcatggtaatgttaatcggagcaaggtacatctcaggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatgtttgaatagaaacctctactaaattattaaaatagacatttagtgttctcacagcttggatatttttctgaaaagttatttgccaaaactgaaatccttcagatgttttccatggtcccactaattataatgactttctgtctggatcttataggaaaagatactttcttttttcttccatctttcctttttatattttttactttgtatgtataacatacatgcctatatattttatacactgagggtagcccatttataaattaagagcacattatattcagaaggttctaacagggctggtcttaagtgaaccactgtgtatataaatatgttggaaaacagctgtatacatttttgggcaacggttatgcataatatttaccaggagaatttttttcttaacaagccaacatttaaaatttatgttttatgtcaataaaagaaaatatactttattgtgacttcaactatatttcttatcccttacatttttatttaattgtcttagcttaaaaaaagaagaaactgtggaatactacagtaaatattgttttcaaacacaagcaataattcaaatagttatttttcttttgaattaattttagacatattttggatcctattgaggggataagaggatgtcaaaaaagttaaatacctaagtagaaaaaaatatagaaataaagccaagaatctctttcagttcaaatgttatcaattgttaataagaaattgctatctgggatgacagaattacctctgcttagtatctcattataactgaaagaaggtttatcattacaaataccttccaatgaaaccaagaatttctcaaaatatttaatgtcacatattataagaagttacctaatcctgcttcttaacatcaatttttaaaaatatcttaaaattactttgttttgtagtaaacagtgaagaaaagattgcctcctaattatttttttcaatgagtgctgaatgggaaaacatttatatcttactataaaaggttctgttttgtttggaatcaatggtagctttattgactgttctgattgtgctgtttctaatttattgaatctgctaggttttattgatgcagccaccacttaagtgacataaatattatagaaaggtactgtgaaatgatcactttgtggcaggggtacttttaaacataaatgtttctacaaaagtaggttgagttcattgtaaataattgtgaaagccactgttcaaataattttaagattacattaatttttctataaattggaagatttataaatgtttgaaattgtacacattgatatttaatgacaaatttacttaaaataaattgaccccttgttcttacttgcatttctcatttacagactagaacttagttgaaagttaaattaagaaagatgtttcagaggccgggcacggtggctgacgcctgtaatcccagcactttgggaggccgaggtgggcagatcacctgaggtcaggagttcgggactagcctaaccgacatggagaaaccctatctctactaaaaaaaaaaaaagatgtttcaggacatgtgaaacttggctgttagcgcttgatagggcacactctgaagagttaaccaacagccaaagaagtaatttctgtaatgatgaacactttaatcattctattagaagaaactacactgtcccatctcagcatttgcaaaaaataatgttggtaaggtcagcagccattatcaacagggccttgcatggctaactttgaccaccatttttctctcaacctgataggcaacacctcaatcctttgttctccaactaatcagtaaaataagtaatgcatctctgcttctgtaatgatatcttagaatttttagtatgtttcttttgaagtgcccaaagcccaattctttgggatatcttttgggtatctggtatcatgtgggagtgaagaaagaaagtttttggagaaaccaacaaatgaaagctgtgatagcacagaagctaatggcattgacagtggagtaggtagtatttaatctgtagtgtttacaacatagtagatagaagtacaaaaatttttttaactataactctttaatagcttgttttatctagtaatatttaaataatgaagtttccttgatcctttgcttttgcaacctaacaactttaataataagttcacacaataaacaaattagt

SEQ ID NO: 137897 - DNA, 371 bp, Homo sapiens
  Payload ID: 7004
  Gene Symbol: GK
  Gene Name: glycerol kinase
  ENST ID: ENST00000425166
  CDS Start-End: 1-371
aatgctccagctgctccagtttctcctggcccttcagttccagttgccgttgttccctctggctcttcagttccagctcctggtacttcctcagtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaatggaggtgtccactgtacagatgtaacaaatgcaagtaggac

SEQ ID NO: 137898 - DNA, 420 bp, Homo sapiens
  Payload ID: 7004
  Gene Symbol: GK
  Gene Name: glycerol kinase
  ENST ID: ENST00000471362
  CDS Start-End: 32-304
cgcaatcgccggccgacctgaagctggtttcatggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggctattggtgtcagcaaccagagggaaaccactgtagtctgggacaagataactggagagcctctctacaatgctgtggtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaat

SEQ ID NO: 137899 - DNA, 2401 bp, Homo sapiens
  Payload ID: 7004
  Gene Symbol: GK
  Gene Name: glycerol kinase
  ENST ID: ENST00000481024
  CDS Start-End: 50-358
gtcacccaggaaaccggccgcaatcgccggccgacctgaagctggtttcatggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggatgggtggaacaggaccctaaggaaattctacattctgtctatgagtgtatagagaaaacatgtgagaaacttggacagctcaatattgatatttccaacataaaagataaccctacctcctgcttcatggagaaagttgagggtctgcggccttaaatcctcaccttcctgttgctgtgcttaatatctggatctcctgccaactttccttcatcacaagggcagcaatagccttctgccccacttggagctcctccctccacttgtgctgctattggtgtcagcaaccagagggaaaccactgtagtctgggacaagataactggagagcctctctacaatgctgtggtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaatggaggtgtccactgtacagatgtaacaaatgcaagtaggactatgcttttcaacattcattctttggaatgggataaacaactctgcgaattttttggaattccaatggaaattcttccaaatgtccggagttcttctgagatctatggcctaatgaaaatctctcatagcgtgaaagctggggccttggaaggtgtgccaatatctgggtgtttaggggaccagtctgctgcattggtgggacaaatgtgcttccagattggacaagccaaaaatacgtatggaacaggatgtttcttactatgtaatacaggccataagtgtgtattttctgatcatggccttctcaccacagtggcttacaaacttggcagagacaaaccagtatattatgctttggaaggttctgtagctatagctggtgctgttattcgctggctaagagacaatcttggaattataaagacctcagaagaaattgaaaaacttgctaaagaagtaggtacttcttatggctgctacttcgtcccagcattttcggggttatatgcaccttattgggagcccagcgcaagagggataatctgtggactcactcagttcaccaataaatgccatattgcttttgctgcattagaagctgtttgtttccaaactcgagagattttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggaggaaagtgaaattcgttattctacatggaagaaagctgtgatgaagtcaatgggttgggttacaactcaatctccagaaagtggtgaccctagtatcttctgtagtctgcccttgggcttttttatagtgagtagcatggtaatgttaatcggagcaaggtacatctcaggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatg

SEQ ID NO: 137900 - DNA, 565 bp, Homo sapiens
  Payload ID: 7004
  Gene Symbol: GK
  Gene Name: glycerol kinase
  ENST ID: ENST00000487652
  CDS Start-End: 39-152
aaccggccgcaatcgccggccgacctgaagctggtttcatggcagcctcaaagaaggcagttttggggccattggtgggggcggtggaccagggcaccagttcgacgcgctttttgctattggtgtcagcaaccagagggaaaccactgtagtctgggacaagataactggagagcctctctacaatgctgtggtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaatggaggtgtccactgtacagatgtaacaaatgcaagtaggactatgcttttcaacattcattctttggaatgggataaacaactctgcgaattttttggaattccaatggaaattcttccaaatgtccggagttct

SEQ ID NO: 137901 - DNA, 633 bp, Homo sapiens
  Payload ID: 7004
  Gene Symbol: GK
  Gene Name: glycerol kinase
  ENST ID: ENST00000488296
  CDS Start-End: 1-126
agtgcaagggtagctaagttcaggtgctgtttgattccagactcagacagtatcacctgcatccccctcaagcctgccttttctgggatggctcctgatgtggcatattcaactcccacttcatgagggcagcaggcccaagccacacactgccaagtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaatggaggtgtccactgtacagatgtaacaaatgcaagtaggactatgcttttcaacattcattctttggaatgggataaacaactctgcgaattttttggaattccaatggaaattcttccaaatgtccggagttcttctgagatctatggcctaatgaaagctggggccttggaaggtgtgccaatatctgggtgtttaggggaccagtctgctgcattggtgggacaaatgtgcttccag

SEQ ID NO: 137902 - DNA, 582 bp, Homo sapiens
  Payload ID: 7004
  Gene Symbol: GK
  Gene Name: glycerol kinase
  ENST ID: ENST00000479048
  CDS Start-End: 43-282
aggaaaccggccgcaatcgccggccgacctgaagctggtttcatggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggctattggtgtcagcaaccagagggaaaccactgtagtctgggacaagataactggagagcctctctacaatgctgtggtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggataattttaaaacaaatgccagacatttcattttatttgtaaatatttcaagtttgacaggaggagtcaatggaggtgtccactgtacagatgta

SEQ ID NO: 137903 - DNA, 1942 bp, Homo sapiens
  Payload ID: 7005
  Gene Symbol: GK2
  Gene Name: glycerol kinase 2
  Uniprot ID: Q14410
  ENST ID: ENST00000358842
  CDS Start-End: 94-1755
gccttgtgctcctgactggctgcgctccctgcccccaacaccgccgtggcctgggaaacggtcccagagctgctgagccgacctactggtgtcatggcagccccaaagacagcagctgtggggccgttggtgggagcggtggtccagggcaccaactccactcgctttctggttttcaattcaaaaacagcggaactacttagtcatcacaaagtggaattaacacaagagttcccaaaagaaggatgggtggaacaagaccctaaagaaattcttcagtctgtctacgagtgtatagcgagaacgtgtgagaaacttgacgaactgaatattgatatatccaacataaaagctgttggtgtcagcaatcagagggaaaccactgtaatctgggacaagttaacaggagagcctctctacaatgctgtggtgtggcttgatctaagaacccagactactgttgaggatcttagtaaaaaaattccaggaaatagtaacttcgtcaagtctaagacaggccttccactcagcacttacttcagtgcagtaaaacttcgttggatgcttgacaatgtgagaaacgtccaaaaggctgttgaagaaggtagagctctttttggtaccattgattcatggcttatctggagtttgacaggaggagttaatggaggcgtgcattgtacagatgtaacaaatgcaagtaggacaatgctttttaatatccattctttggaatgggataaagagctctgtgacttttttgaaattccaatggaccttcttccaaatgtcttcagttcttctgagatctatggcctaattaaaactggagccctggaaggtgtgccaatatctgggtgtttgggggaccaatgtgctgcattagtaggacaaatgtgcttccaggagggacaagccaaaaacacctatggaacaggttgcttcttactgtgtaatacgggtcgtaaatgtgtgttttctgaacatggccttttgaccacagtagcttacaaactaggcagagagaagccagcatattatgcactggaaggttctgttgctatagcaggtgctgttattcgttggctaagagacaatcttggaattatagagacctcaggagacattgaaagacttgctaaagaagtaggaacttcttatggctgttactttgtcccagccttttcagggttatatgcaccttattgggagcccagtgcaagagggatactctgtggcctcactcagtttaccaataaatgtcatattgcttttgctgcattagaagctgtttgtttccaaacccgagagattttggaagccatgaaccgtgactgtggaattccacttcgtcatttgcaggtagatggaggaatgaccaacaacaaagttcttatgcagctacaagcagatattcttcatattccagtaataaaaccctttatgcctgaaacaactgcactaggagctgccatggcagcaggggctgcagagggagtaagcgtttggagccttgaaccccaggctttgtcagttctcaggatggaacgatttgaaccacagatccaggccacagaaagtgaaattcgttatgccacatggaagaaagccgtaatgaagtcaatgggttgggttaccagtcagtctcctgaaggtggtgatccttctatcttctctagtctgcctttgggattttttatagtgagtagcatggtaatgctaattggagcaagatatatctcgggtgtgccataataataccagctatggagtcccaagatgtaaacattttacataatgaaagcatatagcagttctgcctcttaatataatgacactattatagactctgattttgtttataaaccacttgctacatgacccatgaaaaccctagacttgtgacctgaaataaagaaaatacgttagaagagcactgtag

SEQ ID NO: 137904 - DNA, 520 bp, Homo sapiens
  Payload ID: 7006
  Gene Symbol: GK5
  Gene Name: glycerol kinase 5 (putative)
  ENST ID: ENST00000463349
  CDS Start-End: 1-52
ttttgttccatcttttagtggattacagaccctgtctcactctgtcacctaggctggagtgcagtaacgcgatcacggctcattgcagcctcaaacccctgggcacaagcaatccttccacctcagcctcccaagtagctgtaactacaggctccattaaatgacccctgggcatgtgcctcttttatgggtttgaagccttctaccagtaaataccatcttgtacgagcaatattggagtcaatagctttcagaaacaaacagttatatgagatgatgaagaaagagattcatattcctgtaagaaaaatccgggcagatggaggagtttgtaagaatggttttgtcatgcagatgacttcagacctgattaatgagaatatagacagacctgccgacattgacatgtcatgcctgggtgcagcttctctagctggccttgctgttgggttttggactgacaaggaggaactaaagaaactgagacaaagtgaagtggttttcaagccacagaagaaat

SEQ ID NO: 137905 - DNA, 9837 bp, Homo sapiens
  Payload ID: 7006
  Gene Symbol: GK5
  Gene Name: glycerol kinase 5 (putative)
  Uniprot ID: Q6ZS86
  ENST ID: ENST00000392993
  CDS Start-End: 153-1742
ggtggagccggcggcaggggccaggcctctctaggctctccggctgagccgggttggggcccgggttgggccgcccggggactctggagcattgggatttgtagcgcgccctctgggtaggcggctgtagcggagaggcgtgcgggatcgggatgtcggggctgctcacggacccggagcagagagcgcaggagccgcggtaccccggcttcgtgctggggctggatgtgggcagttctgtgatccgctgccacgtctatgaccgggcggcgcgggtctgcggctccagcgtgcagaaggtagaaaatctttatcctcaaattggctgggtagaaattgatcctgatgttctttggattcaatttgttgccgtaataaaagaagcagtcaaagctgcaggaatacagatgaatcaaattgttggtcttggcatttcaacacagagagcaacttttattacgtggaacaagaaaacaggaaatcattttcacaactttataagttggcaagacttaagagctgttgaacttgtaaaatcttggaataattctcttcttatgaagatatttcacagttcttgccgagtgcttcactttttcactagaagtaaacgactttttacagccagtttgttcactttcacaacccagcagacttctttgagattggtctggattttacagaacttgactgaggtgcaaaaggcagttgaagaagaaaattgctgctttgggactattgatacctggttgttatataagctcacaaaaggttctgtatatgccacagatttttcaaatgctagtacaactggactttttgacccatataagatgtgttggagtgggatgattacctctctaatttcgataccactttctctcctacctcctgtgagggacacaagccacaattttggatcagtggatgaagagatatttggtgtgcctataccaatagttgccttggttgctgaccagcaatcagccatgtttggagagtgctgcttccagacaggtgatgtgaaattaaccatgggaactgggacatttttggatattaacactggaaatagccttcaacagactactggaggcttttatccattaattgggtggaagattgggcaagaagtcgtatgcttagctgaaagcaatgcaggagacactggtactgccataaaatgggctcagcagttagaccttttcacagatgctgctgagactgaaaaaatggccaaaagtttggaggattctgaaggagtttgttttgttccatcttttagtggattacaggctccattaaatgacccctgggcatgtgcctcttttatgggtttgaagccttctaccagtaaataccatcttgtacgagcaatattggagtcaatagctttcagaaacaaacagttatatgagatgatgaagaaagagattcatattcctgtaagaaaaatccgggcagatggaggagtttgtaagaatggttttgtcatgcagatgacttcagacctgattaatgagaatatagacagacctgccgacattgacatgtcatgcctgggtgcagcttctctagctggccttgctgttgggttttggactgacaaggaggaactaaagaaactgagacaaagtgaagtggttttcaagccacagaagaaatgtcaagaatatgaaatgagtctggaaaactgggccaaagcagtgaaacgctccatgaattggtataacaagacataacactaaatgaaatgatcaaaaccataggtagctggtttatgtgacgtgcagatgagatgaagctcagggataacccatatgacaatgactaagaggagaaaattttaaataagcttcataacttaagaagcattgcttttaaaaaaacaaaacggaacaaaaaactcttatttttttcccctaaaccatggtaaggcagcaatacctcaaaactttatatcttctattttgtagcaaattccaaaggacattagtcatttccaaccacattttgacagttatgggtcctcttcctttttatactgggtcagtggtacataggaacataatgatttaccatccaagctaatagttctgggtcaagtaccatgcacatattgttccaaaattatgtgaaacgtatttctttaattctttaagtgggctatttgaagtacatatagctaaaaagaaagaataactgagaaaatgtggaattttgaaacattaatattttatgtttaaagccataatttcctaatattatatccaaatatgagcttaatatgtccctctcagataagcttatgagatagttaatgctttcctttactggtcttaaagacactgccttaatttttccttgttcaaccaaaatctgagcattctttctatgttgaaaacactgaaaaactaattttagttaatgaactagaaagaatattgatttttaagaaacagaaaaatactacttattttccttctcaaataacgtttctttcaaaaacttctggctgaagtataacatgctggtagttaacataaatcttgtctttctcttgttctttatctttctttgttatttagatgcttgtataaatgtcttttgtttttattaagtgcctaattgacagagcttaatttgaagaagtgccctaatttattgaccacttaagaattgcctttattggggtattttatttgttcctgcgtctttttgatgtttgttcagtctactcatccctgtgagtatgtgtgggggacagctgatagaagggaggagagtgtgtctatgctcaggattgccctttagccactcagccagagatccacagggagcaacaaggacagtttcacatgcttagactttcttggaagaaacagtgaggaggagtaagtcgtgagtagtgtcaagctggatgtagaattgtcctaaggcagttgaccccaccttccaacatgttttcactttatttgcccctccctacatttgggttaggttccatttggatttgcagcaataatgactttatttctctcttggtcaggatttggcacataaaatccttttattatagaactagctattttagttacatagtaatgtaactaatggagagatttatagagaattttgtttttgctgtcatatatgtccattttggagacagatatgatagaactagaaattaagttgcatttctgcaagtgccatttgaatgaacttcaagtatcttcttaattattaaattttctgatgaaggcattgtaacaaatatatagtattattaaatctaattaatatttggaaatattaataaataggtattttatttactgtaaaaagtcaaacttcattatgtagataaatcttattcttttcattctttcccctgtttacatcctttttacaaagcttagtcaccaattaaagctttcctatcaaaatcacatggaagctgctctgttgttttactgttacacattctgtttctcagtgggtgtaatttttttttctttttctttttttgtagagacagggtcttgctgtgttgcccagggtagtctttaattcctggcctcaagtgatcctcccaccttggcctcccaaagtgctgggattgcagccgtgaaccactgcacccagccaatgggtgtaatttcataggaaataattctttttgtcagaatgtactgaattgtaatattaatacctgaaaatttgttagttcacttcttttccacgttcttctttcccaacatataaccacaaaataaaggataaatactttgggctgtgtgcagtggctcatgcctgtaatcccagcactttggcaggctgaagtgggcggatcatttgaggtcaggagtccaacctggtcaaacacggtgaaaccctgtctccactaaaaatacaaaaattagctggatgtggtggtgcaagcctgtaatcccagctactcgggaggctgaggcaggagaattgcttgaatctggggggtggaagttgcagtgagccaagatcatgccactgcactgtagcctgggcaacagagcgacactgcgtctcaaaaaaaaaaaaaaaggatcaatacttttcagataatgttggaaagtaactttgaatgtccctcatcggaattgagcatctcctcaagtgtcagtggctatttttttcttctgtgaatctaaaaactaatattttatttttaatatttgtggccatttttagtgataagactttaataaatatttttggacttaactaaaatcagaaacatgaccacatttgcttttgtggttgcagaaacagttgataagatcaattgagcaacaaaattgtcctttcttttttttttttttttttgagacattgtcatgctctgttgcccaggctggagtgcagtggcatgatctcggctcactgcaacctccctctcctgggctcaagcagtcctcctgcctcagcctcccaagtagctgggatttcaggtatacgtcactacgcccagctgatttttgtatttttagtagagacagggttttaccatgttggccaggctggtctcaaactcctgaccttgtgacccacccacctcggcctcccaaagtgctaggattacaggcgtgagccaccatgcctggcttgtcctttctgtcttccaagtttgtttttcatttgtatgctaatatttgaagtttagaaaaatttgtgctacttctcagcatgttttattttcccattatagatctatcagatatttttagaaggtctgcaactgtctgataaaggaagagaatgttcctgttcaatctatcttaaagtgctactaattgcttttatactatagacatactgattttttcatcttttttatccaaccatggcatggtttcctaatctcagcattgacattttggactggataaatctttattttgggatgctatgctgtactttataggatgtttagcaatatccctgacctctgccctctagctacaagtaccatccccctagttgttatggccaaaaatgtcttcaaacattgccattctgagaggcaaaattgcccccagttgagagccactgatacaggctgttagaagaaaatcgaagactcagtgaatatagtgtcatactccttttctttctgcctcattttaccttaggaaatggttgttagcaaaaaaattagttaatcgtatcttgaaataaatagggtatctattttgctgattaataaagaaaaaataaatctcagctgggcacagtggctcacacctgtaatcctagcactttgggaggccaaggcaggcggatcacttcagctcaggagtttgagaccagcctgggcaacctggcgaatccctatctctacaaaaaatacacaaattagctgggtgtggtgacacacacatatagtcccagctaattagggggctgaggtgggaagatcacttgagctccaggaggtggaggctgcagtgagccaagttggtgtcactgtactctagcctgggtggcaaagtgagaccctgtctcaatcaatcaatcaatcaatcaatcaatatctcatgctgtaattgtcttctgatgttttcatccacccagccccacctctgcagccttaattactggagtaggtccatgatttcagtgtagggttaatgtattctgcagatcatctttgatttgacctgcttttttgcttcctttttatctctgaacaaaggagatcatcattctctttaatctgccttctgtgtaaatctctaccagactggaagctccctgaaagcagaaactgtctgcttccccagaacttagcactgtgctttcatgtatgtgggataaatttttactttgttagtgcaactttgtttgtacacgttatccttgatattacatacatttgttgatgggggcaatttatatttgttgtgagtaaaatacttttttgttggattaagaagaactatactcttcccagcactttgggaggccaaggaggacggattacctgaggttagtagcttgagaccagcctgaccaacatggagaaaccccatctctattaaaactacaaaaaaattagctgtgcgttgtggcacatgcctgtaatcccagctagtcaggaggctgaggcaggagaaccgcttgaacccctgaggcagaggttgcggttgagccgagatcgcgccattgcactccagcctgggcaacaagagttaaactccatttcaaaaaaacaaaaacaaaaacaaaaacaaaaaaacaaaagaagaactactctgtagtgagagctagaatcctcatgttgtttatttaaaatttttggccaagtacagtggctcatgcctgtaatcccagcactttgggaggctgaggccagaggatcacttgaagccaggagttcagttacagcttgggcagcaaagtgagaccttgtctctacaaaaaaattttttttaaattagccaggtgtggtggtatgcccctgtagtcccagctactcaggaaaccgaagcaggagaatcgcttgaacacaggagtttgagggtgctatgagctatgattgtgccactgcactccagcctgggcaacagggcaaggccctgtcttaataaaataaaataaaattcttaatatgtttatatatttgaaaaactatttgtgtagagacacatgtctgtaaatacacatagatatattaactttttaagctttaattgaagcctttctcttcacaggttttatatatttgactgcagatgactaacagattgaattttaagagtgcgaaacactctggtgctatagggaaggaacttcataaatagcccctcctgtaagggaccagtctttaatttaaaacagtccagcccaggaatcttgcaagaattttgtaattatttgaggagagatgtagatataccctggagttctttgactttaagttattctagagtcatcccagagatggcctagaagacttgaatgtaccccaaaggattctgaatccctttgggaaatttagactatgattttcagtaagaattaaaagccccaggataagcgtggtggttcacacctgtaatcccagcaatttgtgaggccaaggcgggaggatcgcttgagctcaggagttcgagaccagcctaggcaacatagtgagaccccacccatctcaatttaaaaaaagagagaaaaaggccaggtgtagtggctcacgcctgtaatcccagcactttgggaggccaaggcgggtggatcacctgaggtcaggagttcaagaccagcctgatcaatatggtgaaaccccatctctactaaaaatacaaaaattagccagtcctgatggcatgtgcctgtggtcccagcgacttgggaggctgagacaggagaattgcttgaacccgggacgtggaggttgcagtgagccgagattgggccactgcattccagcctgggtgagagagcgagactctgtctcaaaaaaaaaaaagagagagagagagagagagagagaaagccccaaacataccttgggcctttacaacctacttggtcccagaatcgtcttattgtaaacccaaagccaggtcttctggttcgaaccagtcaaaatgggtaatctaaaaaagttaaatagatgattcaaaatcgtgttggtggttttttctttttaaatcccctttccaagtaaaaggaatcttttttttttttttaagttttgaagcctcatagccataaatattttggcaccagcatctattggcacctaagtcattggctgtatcatattcccatgggacccttgttcctagaggaatgcaggaatgatcttggagtgggaaggacagaaacaggtgcttgcaaaatcagatatttctgaaattctctgttattctatttctactgtctttccccactttactataaatttgatctgttataaaatggctgtgtttagatagatacccgtgatgtttaggaaacaaatgatatagagactcccatttaaatgaatcttatctttataagaaacagccaaactgttttccagactggctataccatcttacattcccaccaggaatgtatgagtgatccagtttctctgcatgctcgccagcatttggtgttgtcactatttcttatttcaaccattctgtttatccttttcagtgaaatatctgttcatatcttttgcccatttgccaattgaggcaggaggatcacttgagcccaggagttcgaggctgcagtgagatatgatcactaaatgtttgcttaatgagccatatctttaaatatcttttttaaagtttttaaaagtcagtccagtggtttatgtgattatgtgggattttttaaatctttccaggcaaaatgtgtatagcattttgaacatatttacactgtactgagcccaagagttctcatattctttctttgctcattatagagtatggtactaatactgtataatagtaaattttcaaagatacctttatttagaatgttagagtatacagatatatactttgtacatagttatcataatgtttctaacctttttatttaaagcaggctgatttgtgtaaaggtttcagaatgattttgttaataagttattagaaactttcctatttgtacaagatggtaaatgtagattccaatttgtatgcctcagtaaattcataatcttatttctctgatgtgagccactgtgcctggccttctgtgatgctcttaatgaattttgcagttttattaaattgtcattgagaacctcataaatcattgttaagatctatacaaaaaatcaaggatccacagtaatagaatatttttcatctgcatatgaatttttcccttccctttttgtctacttttagatttaaaaaaaattaccaggacattcttattaaatactattacctgttttggtttctgcacattaagaaagtcacagagaagccagacacagtggcatgctcttctattcccagctactcaggaggctgaggctggagaatcacttgagcccaggagtttgaggatatcctgggcaacatggtgaaacttggcaaaaacaaaaacaaggccgggcatggtggctcacacgtgtagtcccagcactttgggaggccacggctggcggatcacgaggtcaggagatcgagaccatcctggctaacatggtgaaaccctgtctctactaaaaatacaaaaaattagccaggcgtggtggcgggtgcctgtactcccagctactcgggaggctgaggcaagagaatggcatgaacccaggaggcggagcttgcagtgagctgagatcgcgccactgcactcctgcctgggtgacagagtgagactccatctcaaaaaaaaaaaacaaaaacaacaacaacaacaacaaaaaacaaccagagaaatagcacttgttaactacaattgtgactctaggtaaacttgggccttaatatggttagacaagaagggttttaggtaacttgcctttttagatcctatttaggcttattagtctatattctacattcttgcacgatggaaattactagagaagtgggataattctttgttgtggggaaaataaaatttgttgtgaaaatatactgtattttaaaatatttagaaagattataaataactggagaaaagataatttcatatactaatatgatggaattagcctagcagatgttaaaaatcctttctgaaaattataatctaaaattatttgggaaattacaatggaactgaataatctgtacgttggtatattaaagccatttttatattgtg

SEQ ID NO: 137906 - DNA, 1103 bp, Homo sapiens
  Payload ID: 7006
  Gene Symbol: GK5
  Gene Name: glycerol kinase 5 (putative)
  ENST ID: ENST00000487672
  CDS Start-End: 138-599
aggggccaggcctctctaggctctccggctgagccgggttggggcccgggttgggccgcccggggactctggagcattgggatttgtagcgcgccctctgggtaggcggctgtagcggagaggcgtgcgggatcgggatgtcggggctgctcacggacccggagcagagagcgcaggagccgcggtaccccggcttcgtgctggggctggatgtgggcagttctgtgatccgctgccacgtctatgaccgggcggcgcgggtctgcggctccagcgtgcagaaggtagaaaatctttatcctcaaattggctgggtagaaattgatcctgatgttctttggattcaatttgttgccgtaataaaagaagcagtcaaagctgcaggaatacagatgaatcaaattgttggtcttggcatttcaacacagagagcaacttttattacgtggaacaagaaaacaggaaatcattttcacaactttataagttggcaagacttaagagctgttgaacttgtaaaatcttggaataattctcttcttatgaaggtaatctttttcttgtgtgatttggatattgttggttttttttttctgtaaatgtcccttaattgtattatttcctacctattttgttttaggacattaagaagacatacgcacacactccccattccagtgaagtttaataatagccaatcaaaggcgtatgtggtagacttcagtacttgtacctcaggaagttctaaggaggtttgtggtggaccagagtttcacatgttagtgagaatttgtgtttctgtccttgagaaatggaaaagatacagactagatgaatgaaatgcccaaatttcatcttttataaaagctcaggatggatattgagatattatagataactagcagactgttagaagctcttatcattacaggcatgatggctcgcgcctgtaatctcaacactttggaaggctgaggcagggggattgcttgaggccagaagttcaagaccagcttgggcaacatgatatttcacagttcttgccgagtgcttcactttttcactagaagtaaacgactttttacagccagtttgttcacttt

SEQ ID NO: 137907 - DNA, 4479 bp, Homo sapiens
  Payload ID: 7006
  Gene Symbol: GK5
  Gene Name: glycerol kinase 5 (putative)
  Uniprot ID: Q6ZS86
  ENST ID: ENST00000480757
  CDS Start-End: 94-999
cccgggttgggccgcccggggactctggagcattgggatttgtagcgcgccctctgggtaggcggctgtagcggagaggcgtgcgggatcgggatgtcggggctgctcacggacccggagcagagagcgcaggagccgcggtaccccggcttcgtgctggggctggatgtgggcagttctgtgatccgctgccacgtctatgaccgggcggcgcgggtctgcggctccagcgtgcagaaggtagaaaatctttatcctcaaattggctgggtagaaattgatcctgatgttctttggattcaatttgttgccgtaataaaagaagcagtcaaagctgcaggaatacagatgaatcaaattgttggtcttggcatttcaacacagagagcaacttttattacgtggaacaagaaaacaggaaatcattttcacaactttataagttggcaagacttaagagctgttgaacttgtaaaatcttggaataattctcttcttatgaagatatttcacagttcttgccgagtgcttcactttttcactagaagtaaacgactttttacagccagtttgttcactttcacaacccagcagacttctttgagattggtctggattttacagaacttgactgaggtgcaaaaggcagttgaagaagaaaattgctgctttgggactattgatacctggttgttatataagctcacaaaaggttctgtatatgccacagatttttcaaatgctagtacaactggactttttgacccatataagatgtgttggagtgggatgattacctctctaatttcgataccactttctctcctacctcctgtgagggacacaagccacaattttggatcagtggatgaagagatatttggtgtgcctataccaatagttgccttgttaaaggtccctggatatgaccagaatatctgctatatttttgggaaggggaccattgagccagtattctatcatggaagtactttataaccttttctgacttgcttgtatattgtttatcagaaaacttaaattaaaaaaaattttttttaattctgagtggtatttagtttacatttggtactctgagacaaaacacagtgatggggcgaatatttatgttctgtttgataatgtgtaaccacaaacagtgttagggcaacttaaactagcagagaaagttgtatgtacatttaataaagtccttagccatcatctaccagtaaataagtttgtagaataatgaaatatttgccatttttgatttttttttttttttttgagacagggtctcactctgtcactcaggctggagtgcagtggtataatcatgcctcactgcagcctcggcttcctgggctcaggtgattcttccaccccagcctcccaagtagccaagaccacaggtgtgtgccacgacacctggctaattttttgtatttttggtagacataggattttgctgtgttcccctggctgatctcgaactcctagactggggccttctgccacctttgcctcccaaagtgctgggactacaggcatgagtcactgtgccaagcctgtttttgatttttaagagtcctttcacattgcctttgatttcctgtggcagcttaagcaggaggtagagaccacctgttgcaagatgtgcagtctccacagtagctgggggagcagctgagggaaagggaatttaatttccaagttacaaaatcattatcatttagagaggatcggtcttattcaatctaggcataggtgcagggttagattaaggtatggctggaagagttaccaattagtgacagagggttctttaaatgagttgttgttgttgttgttgtttttgagatggagtttcactcttgtctcccagactggagtgcaatggcatgatctcaccgatggctcactgtgacctccgcctctcgggttcaagtgactcttctgcctcagcctcctgagtagctaggactataggttgctgaccagcaatcagccatgtttggagagtgctgcttccagacaggtgatgtgaaattaaccatgggaactgggacatttttggatattaacactggaaatagccttcaacagactactggaggcttttatccattaattgggtggaagattgggcaagaagtcgtatgcttagctgaaagcaatgcaggagacactggtactgccataaaatgggctcagcagttagaccttttcacagatgctgctgagactgaaaaaatggccaaaagtttggaggattctgaaggagtttgttttgttccatcttttagtggattacaggctccattaaatgacccctgggcatgtgcctcttttatgggtttgaagccttctaccagtaaataccatcttgtacgagcaatattggagtcaatagctttcagaaacaaacagttatatgagatgatgaagaaagagattcatattcctgtaagaaaaatccgggcagatggaggagtttgtaagaatggttttgtcatgcagatgacttcagacctgattaatgagaatatagacagacctgccgacattgacatgtcatgcctgggtgcagcttctctagctggccttgctgttgggttttggactgacaaggaggaactaaagaaactgagacaaagtgaagtggttttcaagccacagaagaaatgtcaagaatatgaaatgagtctggaaaactgggccaaagcagtgaaacgctccatgaattggtataacaagacataacactaaatgaaatgatcaaaaccataggtagctggtttatgtgacgtgcagatgagatgaagctcagggataacccatatgacaatgactaagaggagaaaattttaaataagcttcataacttaagaagcattgcttttaaaaaaacaaaacggaacaaaaaactcttatttttttcccctaaaccatggtaaggcagcaatacctcaaaactttatatcttctattttgtagcaaattccaaaggacattagtcatttccaaccacattttgacagttatgggtcctcttcctttttatactgggtcagtggtacataggaacataatgatttaccatccaagctaatagttctgggtcaagtaccatgcacatattgttccaaaattatgtgaaacgtatttctttaattctttaagtgggctatttgaagtacatatagctaaaaagaaagaataactgagaaaatgtggaattttgaaacattaatattttatgtttaaagccataatttcctaatattatatccaaatatgagcttaatatgtccctctcagataagcttatgagatagttaatgctttcctttactggtcttaaagacactgccttaatttttccttgttcaaccaaaatctgagcattctttctatgttgaaaacactgaaaaactaattttagttaatgaactagaaagaatattgatttttaagaaacagaaaaatactacttattttccttctcaaataacgtttctttcaaaaacttctggctgaagtataacatgctggtagttaacataaatcttgtctttctcttgttctttatctttctttgttatttagatgcttgtataaatgtcttttgtttttattaagtgcctaattgacagagcttaatttgaagaagtgccctaatttattgaccacttaagaattgcctttattggggtattttatttgttcctgcgtctttttgatgtttgttcagtctactcatccctgtgagtatgtgtgggggacagctgatagaagggaggagagtgtgtctatgctcaggattgccctttagccactcagccagagatccacagggagcaacaaggacagtttcacatgcttagactttcttggaagaaacagtgaggaggagtaagtcgtgagtagtgtcaagctggatgtagaattgtcctaaggcagttgaccccaccttccaacatgttttcactttatttgcccctccctacatttgggttaggttccatttggatttgcagcaataatgactttatttctctcttggtcaggatttggcacataaaatccttttattatagaactagctattttagttacatagtaatgtaactaatggagagatttatagagaattttgtttttgctgtcatatatgtccattttggagacagatatgatagaactagaaattaagttgcatttctgcaagtgccatttgaatgaacttcaagtatcttcttaattattaaattttctgatgaaggcattgtaacaaatatatagtattattaaatctaattaatatttggaaatattaataaataggtattttatttactgtaaaaagtcaaacttcattatgtagataaatcttattcttttcattctttcccctgtttacatcctttttacaaagcttagtcaccaattaaagctttcctatcaaaatcacat

SEQ ID NO: 137908 - DNA, 3049 bp, Homo sapiens
  Payload ID: 7006
  Gene Symbol: GK5
  Gene Name: glycerol kinase 5 (putative)
  Uniprot ID: Q6ZS86
  ENST ID: ENST00000492097
  CDS Start-End: 113-1018
cggctgagccgggttggggcccgggttgggccgcccggggactctggagcattgggatttgtagcgcgccctctgggtaggcggctgtagcggagaggcgtgcgggatcgggatgtcggggctgctcacggacccggagcagagagcgcaggagccgcggtaccccggcttcgtgctggggctggatgtgggcagttctgtgatccgctgccacgtctatgaccgggcggcgcgggtctgcggctccagcgtgcagaaggtagaaaatctttatcctcaaattggctgggtagaaattgatcctgatgttctttggattcaatttgttgccgtaataaaagaagcagtcaaagctgcaggaatacagatgaatcaaattgttggtcttggcatttcaacacagagagcaacttttattacgtggaacaagaaaacaggaaatcattttcacaactttataagttggcaagacttaagagctgttgaacttgtaaaatcttggaataattctcttcttatgaagatatttcacagttcttgccgagtgcttcactttttcactagaagtaaacgactttttacagccagtttgttcactttcacaacccagcagacttctttgagattggtctggattttacagaacttgactgaggtgcaaaaggcagttgaagaagaaaattgctgctttgggactattgatacctggttgttatataagctcacaaaaggttctgtatatgccacagatttttcaaatgctagtacaactggactttttgacccatataagatgtgttggagtgggatgattacctctctaatttcgataccactttctctcctacctcctgtgagggacacaagccacaattttggatcagtggatgaagagatatttggtgtgcctataccaatagttgccttgttaaaggtccctggatatgaccagaatatctgctatatttttgggaaggggaccattgagccagtattctatcatggaagtactttataaccttttctgacttgcttgtatattgtttatcagaaaacttaaattaaaaaaaattttttttaattctgagtggtatttagtttacatttggtactctgagacaaaacacagtgatggggcgaatatttatgttctgtttgataatgtgtaaccacaaacagtgttagggcaacttaaactagcagagaaagttgtatgtacatttaataaagtccttagccatcatctaccagtaaataagtttgtagaataatgaaatatttgccatttttgatttttttttttttttttgagacagggtctcactctgtcactcaggctggagtgcagtggtataatcatgcctcactgcagcctcggcttcctgggctcaggtgattcttccaccccagcctcccaagtagccaagaccacaggtgtgtgccacgacacctggctaattttttgtatttttggtagacataggattttgctgtgttcccctggctgatctcgaactcctagactggggccttctgccacctttgcctcccaaagtgctgggactacaggcatgagtcactgtgccaagcctgtttttgatttttaagagtcctttcacattgcctttgatttcctgtggcagcttaagcaggaggtagagaccacctgttgcaagatgtgcagtctccacagtagctgggggagcagctgagggaaagggaatttaatttccaagttacaaaatcattatcatttagagaggatcggtcttattcaatctaggcataggtgcagggttagattaaggtatggctggaagagttaccaattagtgacagagggttctttaaatgagttgttgttgttgttgttgtttttgagatggagtttcactcttgtctcccagactggagtgcaatggcatgatctcaccgatggctcactgtgacctccgcctctcgggttcaagtgactcttctgcctcagcctcctgagtagctaggactataggttgctgaccagcaatcagccatgtttggagagtgctgcttccagacaggtgatgtgaaattaaccatgggaactgggacatttttggatattaacactggaaatagccttcaacagactactggaggcttttatccattaattgggtggaagattgggcaagaagtcgtatgcttagctgaaagcaatgcaggagacactggtactgccataaaatgggctcagcagttagggttttttgttgtttgtttgtttttgcagaccttttcacagatgctgctgagactgaaaaaatggccaaaagtttggaggattctgaaggagtttgttttgttccatcttttagtggattacaggctccattaaatgacccctgggcatgtgcctcttttatgggtttgaagccttctaccagtaaataccatcttgtacgagcaatattggagtcaatagctttcagaaacaaacagttatatgagatgatgaagaaagagattcatattcctgtaagaaaaatccgggcagatggaggagtttgtaagaatggttttgtcatgcagatgacttcagacctgattaatgagaatatagacagacctgccgacattgacatgtcatgcctgggtgcagcttctctagctggccttgctgttgggttttggactgacaaggaggaactaaagaaactgagacaaagtgaagtggttttcaagccacagaagaaatgtcaagaatatgaaatgagtctggaaaactgggccaaagcagtgaaacgctccatgaattgggtcttgctgtgttgcccagggtagtctttaattcctggcctcaagtgatcctcccaccttggcctcccaaagtgctgggattgcagccgtgaaccactgcacccagccaatgggtgtaatttcataggaaataattctttttgtcagaatgtactgaattgtaatattaatacctgaaaatttgttagttcacttcttttccacgttcttctttcccaacatataaccacaaaataaaggataaatactt

SEQ ID NO: 137909 - DNA, 545 bp, Homo sapiens
  Payload ID: 7006
  Gene Symbol: GK5
  Gene Name: glycerol kinase 5 (putative)
  ENST ID: ENST00000486459
  CDS Start-End: 1-519
cagcagttagaccttttcacagatgctgctgagactgaaaaaatggccaaaagtttggaggattctgaaggagtttgttttgttccatcttttagtggattacaggctccattaaatgacccctgggcatgtgcctcttttatgggtttgaagccttctaccagtaaataccatcttgtacgagcaatattggagtcaatagctttcagaaacaaacagttatatgagatgatgaagaaagagattcatattcctgtaagaaaaatccgggcagatggaggagtttgtaagaatggttttgtcatgcagatgacttcagacctgattaatgagaatatagacagacctgccgacattgacatgtcatgcctgggtgcagcttctctagctggccttgctgttggtatgtgtgaaatttataagaatgagagttttcttgcaaactcttccttacagatagcatttctcctctcaaattacaaaattctagagagtctggaaagccttggcgtccattaaactccatacacatatgcatattactc

SEQ ID NO: 137910 - DNA, 2761 bp, Homo sapiens
  Payload ID: 7007
  Gene Symbol: GPAT2
  Gene Name: glycerol-3-phosphate acyltransferase 2, mitochondrial
  Uniprot ID: Q6NUI2
  ENST ID: ENST00000359548
  CDS Start-End: 161-2548
agtccacgccttgtggcggctttgcggagctgctgctttggcgggagttggaagctggtgtgaggtgagaggcgcggtggtcgctccccggcgaggccaggtttctgtggggagaaggagagtgccagaggtgactggttcatggttcttctaggctctcatggccaccatgttggaaggcagatgccaaactcagccaaggagcagccccagtggccgagaggctagcctgtggtcgtcaggctttgggatgaagctggaggctgtcactccattcctggggaagtatcgcccctttgtgggtcgctgttgccagacctgcacccccaagagctgggagtccctcttccacagaagcataacggacctaggcttctgcaatgtgatcctggtgaaggaggagaacacaaggtttcggggctggctggttcggaggctctgctatttcctgtggtccctggagcagcacatccccccctgccaggatgtcccacagaagatcatggaaagcaccggggtgcagaacctcctctcagggagggtcccaggaggcactggggaaggccaggtgcctgaccttgtgaagaaggaggtacagcgcatcctgggtcacatccaggccccaccccgtcccttcctggtcaggctgttcagctgggcgctgctgaggttcctgaactgcctgttcctgaatgtgcagctccacaagggtcagatgaagatggtccagaaggccgcccaggcaggcttgccgcttgtcctcctctctactcacaaaaccctcctggatgggatcctgctgccctttatgctgctctcccagggcctgggtgtgcttcgtgtggcctgggactcccgcgcctgctcccctgccctcagagctctgctgaggaagcttggggggcttttcctgcccccagaggccagcctctccctggacagctctgaggggctccttgccagggctgtggtccaggcggtcatagagcagctgctggttagtgggcagcccctgctcatcttcctggaggaacctcctggggctctggggccacggctgtcagccctgggccaggcttgggtggggtttgtggtgcaggcagtccaggtgggcatcgtcccagatgctctgctggtaccagtggccgtcacctatgacctggttccggatgcaccgtgtgacatagaccatgcctcggcccccctggggctgtggacaggagctctggctgtcctacgtagcttgtggagccgctggggctgcagccaccggatctgctcccgggtgcacctagctcagcccttttccctgcaggaatacatcgtcagtgccagaagctgctggggcggcagacagaccctggagcagctactgcagcccatcgtgctgggccaatgtactgctgtcccagacactgagaaggagcaggagtggacccccataactgggcctctcctggccctcaaggaagaggaccagctcctggtcaggagactgagctgtcatgtcctgagtgccagtgtagggagctctgcggtgatgagcacggccattatggcaacgctgctgctcttcaagcatcagaagctcctgggggagttctcctggctgacggaggagatactgttgcgtggctttgatgtaggcttctctgggcagctgcggagcctgctgcagcactcactgagcctgctgcgggcgcacgtggccctgctgcgcatccgtcagggtgacttgctggtggtgccgcagcctggcccaggcctcacacacctggcacaactgagtgctgagctgctgcccgtcttcctgagcgaggctgtgggcgcctgtgcagtgcgggggctgctggcaggcagagtgccgccccaggggccctgggagctgcagggcatattgctgctgagccagaatgagctgtaccgccagatcctgctgctgatgcacctgctgccgcaagacctgctgctgctaaagccctgccagtcttcctactgctactgtcaggaggtgctggaccggctcatccaatgcgggctcctggttgctgaggagaccccaggctcccggccagcctgtgacacagggcgacagcgattgagcagaaagctgctgtggaaaccgagtggggactttactgatagtgacagtgatgacttcggagaggctgacggccggtacttcaggctcagccagcagtcacactgcccagatttctttcttttcctctgccgcctgctcagcccgctgctcaaggcctttgcacaggctgccgccttcctccgccagggccagctgcccgatactgagttgggctacacagagcagctgttccagttcctgcaggccaccgcccaggaagaagggatcttcgagtgtgcggacccaaagctcgccatcagtgctgtctggaccttcagagacctaggggttctgcagcagacgccgagccctgcaggccccaggctccacctgtcccctacttttgccagcctggacaatcaggaaaaactagaacagttcatccggcagttcatttgtagctagaactgtgaggaggagcctgtgctgagacttctcagccccagaacacagctgtgtcctagagccagaagatggagaggaggctgcaaacccttagctgctctataaatataatcattgaggcttgattgtcccttgccatctcttgctttttcccttctttgatgtgataaacaaggggacgagacgagttgtcttttccccagcccagcagca

SEQ ID NO: 137911 - DNA, 3061 bp, Homo sapiens
  Payload ID: 7007
  Gene Symbol: GPAT2
  Gene Name: glycerol-3-phosphate acyltransferase 2, mitochondrial
  Uniprot ID: Q6NUI2
  ENST ID: ENST00000434632
  CDS Start-End: 461-2848
gtttttcagcgtcagagtctcaggatctcgatgtggacaggcaccctgatacaaaagaacgctcagaattttgctagagccgaaccccagcttggaggagcgtaagccctgggataacttctttaatcagaatctggcctgagtccctgctcgaagctcaagcacccggggcctcgcggccgcctgcagtactcccctcccaccgcgggccagggccgactggaaaacggagcaggccatccccagagcacgggtcccgtggccacgttgagtgtcgcagagtacgggacgcagggcggggcttctggaccagcgcgcatcccaattggctctcggggctgccttttagccggacgcgcggaggtgggcaatccgctccttcccttgagcagtccacgccttgtggcggctttgcggagctgctgctttggcgggagttggaagctggtgtgaggctctcatggccaccatgttggaaggcagatgccaaactcagccaaggagcagccccagtggccgagaggctagcctgtggtcgtcaggctttgggatgaagctggaggctgtcactccattcctggggaagtatcgcccctttgtgggtcgctgttgccagacctgcacccccaagagctgggagtccctcttccacagaagcataacggacctaggcttctgcaatgtgatcctggtgaaggaggagaacacaaggtttcggggctggctggttcggaggctctgctatttcctgtggtccctggagcagcacatccccccctgccaggatgtcccacagaagatcatggaaagcaccggggtgcagaacctcctctcagggagggtcccaggaggcactggggaaggccaggtgcctgaccttgtgaagaaggaggtacagcgcatcctgggtcacatccaggccccaccccgtcccttcctggtcaggctgttcagctgggcgctgctgaggttcctgaactgcctgttcctgaatgtgcagctccacaagggtcagatgaagatggtccagaaggccgcccaggcaggcttgccgcttgtcctcctctctactcacaaaaccctcctggatgggatcctgctgccctttatgctgctctcccagggcctgggtgtgcttcgtgtggcctgggactcccgcgcctgctcccctgccctcagagctctgctgaggaagcttggggggcttttcctgcccccagaggccagcctctccctggacagctctgaggggctccttgccagggctgtggtccaggcggtcatagagcagctgctggttagtgggcagcccctgctcatcttcctggaggaacctcctggggctctggggccacggctgtcagccctgggccaggcttgggtggggtttgtggtgcaggcagtccaggtgggcatcgtcccagatgctctgctggtaccagtggccgtcacctatgacctggttccggatgcaccgtgtgacatagaccatgcctcggcccccctggggctgtggacaggagctctggctgtcctacgtagcttgtggagccgctggggctgcagccaccggatctgctcccgggtgcacctagctcagcccttttccctgcaggaatacatcgtcagtgccagaagctgctggggcggcagacagaccctggagcagctactgcagcccatcgtgctgggccaatgtactgctgtcccagacactgagaaggagcaggagtggacccccataactgggcctctcctggccctcaaggaagaggaccagctcctggtcaggagactgagctgtcatgtcctgagtgccagtgtagggagctctgcggtgatgagcacggccattatggcaacgctgctgctcttcaagcatcagaagctcctgggggagttctcctggctgacggaggagatactgttgcgtggctttgatgtaggcttctctgggcagctgcggagcctgctgcagcactcactgagcctgctgcgggcgcacgtggccctgctgcgcatccgtcagggtgacttgctggtggtgccgcagcctggcccaggcctcacacacctggcacaactgagtgctgagctgctgcccgtcttcctgagcgaggctgtgggcgcctgtgcagtgcgggggctgctggcaggcagagtgccgccccaggggccctgggagctgcagggcatattgctgctgagccagaatgagctgtaccgccagatcctgctgctgatgcacctgctgccgcaagacctgctgctgctaaagccctgccagtcttcctactgctactgtcaggaggtgctggaccggctcatccaatgcgggctcctggttgctgaggagaccccaggctcccggccagcctgtgacacagggcgacagcgattgagcagaaagctgctgtggaaaccgagtggggactttactgatagtgacagtgatgacttcggagaggctgacggccggtacttcaggctcagccagcagtcacactgcccagatttctttcttttcctctgccgcctgctcagcccgctgctcaaggcctttgcacaggctgccgccttcctccgccagggccagctgcccgatactgagttgggctacacagagcagctgttccagttcctgcaggccaccgcccaggaagaagggatcttcgagtgtgcggacccaaagctcgccatcagtgctgtctggaccttcagagacctaggggttctgcagcagacgccgagccctgcaggccccaggctccacctgtcccctacttttgccagcctggacaatcaggaaaaactagaacagttcatccggcagttcatttgtagctagaactgtgaggaggagcctgtgctgagacttctcagccccagaacacagctgtgtcctagagccagaagatggagaggaggctgcaaacccttagctgctctataaatataatcattgaggcttgattgtcccttgccatctcttgctttttcccttctttgatgtgataaacaaggggacgagacgagttgtcttttccccagcccagcagca

SEQ ID NO: 137912 - DNA, 2466 bp, Homo sapiens
  Payload ID: 7007
  Gene Symbol: GPAT2
  Gene Name: glycerol-3-phosphate acyltransferase 2, mitochondrial
  ENST ID: ENST00000453542
  CDS Start-End: 80-2254
cccttgagcagtccacgccttgtggcggctttgcggagctgctgctttggcgggagttggaagctggtgtgaggctctcatggccaccatgttggaaggcagatgccaaactcagccaaggagcagccccagtggccgagaggctagcctgtggtcgtcaggctttgggatgaagctggaggctgtcactccattcctggggaagtatcgcccctttgtgggtcgctgttgccagacctgcacccccaagagctgggagtccctcttccacagaagcataacggacctaggcttctgcaatgtgatcctggtgaaggaggagaacacaaggtttcggggctggctggttcggaggctctgctatttcctgtggtccctggagcagcacatccccccctgccaggatgtcccacagaagatcatggaaagcaccggggtgcagaacctcctctcagggagggtcccaggaggcactggggaaggccaggtgcctgaccttgtgaagaaggaggtacagcgcatcctgggtcacatccaggccccaccccgtcccttcctggtcaggctgttcagctgggcgctgctgaggttcctgaactgcctgttcctgaatgtgcagctccacaagggtcagatgaagatggtccagaaggccgcccaggcaggcttgccgcttgtcctcctctctactcacaaaaccctcctggatgggatcctgctgccctttatgctgctctcccagggcctgggtgtgcttcgtgtggcctgggactcccgcgcctgctcccctgccctcagagctctgctgaggaagcttggggggcttttcctgcccccagaggccagcctctccctggacagctctgaggggctccttgccagggctgtggtccaggcggcctcggcccccctggggctgtggacaggagctctggctgtcctacgtagcttgtggagccgctggggctgcagccaccggatctgctcccgggtgcacctagctcagcccttttccctgcaggaatacatcgtcagtgccagaagctgctggggcggcagacagaccctggagcagctactgcagcccatcgtgctgggccaatgtactgctgtcccagacactgagaaggagcaggagtggacccccataactgggcctctcctggccctcaaggaagaggaccagctcctggtcaggagactgagctgtcatgtcctgagtgccagtgtagggagctctgcggtgatgagcacggccattatggcaacgctgctgctcttcaagcatcagaagctcctgggggagttctcctggctgacggaggagatactgttgcgtggctttgatgtaggcttctctgggcagctgcggagcctgctgcagcactcactgagcctgctgcgggcgcacgtggccctgctgcgcatccgtcagggtgacttgctggtggtgccgcagcctggcccaggcctcacacacctggcacaactgagtgctgagctgctgcccgtcttcctgagcgaggctgtgggcgcctgtgcagtgcgggggctgctggcaggcagagtgccgccccaggggccctgggagctgcagggcatattgctgctgagccagaatgagctgtaccgccagatcctgctgctgatgcacctgctgccgcaagacctgctgctgctaaagccctgccagtcttcctactgctactgtcaggaggtgctggaccggctcatccaatgcgggctcctggttgctgaggagaccccaggctcccggccagcctgtgacacagggcgacagcgattgagcagaaagctgctgtggaaaccgagtggggactttactgatagtgacagtgatgacttcggagaggctgacggccggtacttcaggctcagccagcagtcacactgcccagatttctttcttttcctctgccgcctgctcagcccgctgctcaaggcctttgcacaggctgccgccttcctccgccagggccagctgcccgatactgagttgggctacacagagcagctgttccagttcctgcaggccaccgcccaggaagaagggatcttcgagtgtgcggacccaaagctcgccatcagtgctgtctggaccttcagagacctaggggttctgcagcagacgccgagccctgcaggccccaggctccacctgtcccctacttttgccagcctggacaatcaggaaaaactagaacagttcatccggcagttcatttgtagctagaactgtgaggaggagcctgtgctgagacttctcagccccagaacacagctgtgtcctagagccagaagatggagaggaggctgcaaacccttagctgctctataaatataatcattgaggcttgattgtcccttgccatctcttgctttttcccttctttgatgtgataaacaaggggacgagacgagttgtcttttccccagcccagcagc

SEQ ID NO: 137913 - DNA, 588 bp, Homo sapiens
  Payload ID: 7007
  Gene Symbol: GPAT2
  Gene Name: glycerol-3-phosphate acyltransferase 2, mitochondrial
  ENST ID: ENST00000439254
  CDS Start-End: 109-588
gcagtccacgccttgtggcggctttgcggagctgctgctttggcgggagttggaagctggtgtgaggtgagaggcgcggtggtcgctccccggcgaggccaggctctcatggccaccatgttggaaggcagatgccaaactcagccaaggagcagccccagtggccgagaggctagcctgtggtcgtcaggctttgggatgaagctggaggctgtcactccattcctggggaagtatcgcccctttgtgggtcgctgttgccagacctgcacccccaagagctgggagtccctcttccacagaagcataacggacctaggcttctgcaatgtgatcctggtgaaggaggagaacacaaggtttcggggctggctggttcggaggctctgctatttcctgtggtccctggagcagcacatccccccctgccaggatgtcccacagaagatcatggaaagcaccggggtgcagaacctcctctcagggagggtcccaggaggcactggggaaggccaggtgcctgaccttgtgaagaaggaggtacagcgcatcctgggtcacatccaggccccaccccgtcccttcctg

SEQ ID NO: 137914 - DNA, 2625 bp, Homo sapiens
  Payload ID: 7008
  Gene Symbol: GPAT3
  Gene Name: glycerol-3-phosphate acyltransferase 3
  Uniprot ID: Q53EU6
  ENST ID: ENST00000264409
  CDS Start-End: 213-1517
gttaactggcaggggcgaggaggagcccagggaggaaggaaggatattgccgtaattctgaaagtttttttccttcctctcttcccttcgcagaggtgagtgccgggctcggcgctctgctcctggagctcccgcgggactgcctggggacagggactgctgtggcgctcggccctccactgcggacctctcctgagtgggtgcgccgagtcatggagggcgcagagctggccgggaagatcctttccacctggctgacgctggttctcggcttcatccttttaccttcggtcttcggagtgtctctgggcatctccgagatctacatgaagatcctagtgaaaactttagagtgggccacaatacgaattgaaaaaggaaccccaaaggagtcgattcttaaaaactctgcttctgttggtattatccaaagagatgagtcacccatggaaaaagggctctctggtctacgaggaagggactttgagctgtctgacgtgttttatttctccaagaagggattggaagccattgtagaagatgaagtgacccagaggttttcctcagaggagctagtgtcatggaatctcctcacaagaaccaatgtaaatttccagtacatcagtctgcggctcactatggtgtgggtgctgggcgtcatagtgcgctattgtgtcctactgcctctgagggttaccttggctttcattgggatcagtttgctggttataggaactacactggttgggcagctgccagacagcagcctcaaaaactggctgagtgaactggtccatctgacttgctgccggatctgtgtgcgagccctctctggtaccattcattatcataacaagcagtacagaccccagaagggaggcatttgtgttgccaaccatacttcccccattgatgttttaatcttgacaacggatggatgttatgctatggttggccaggttcatggcggcttgatgggaattattcagagagctatggtcaaggcttgtcctcatgtctggtttgaacgctcagaaatgaaggatcgacacctggttactaagagactaaaagaacatattgctgataagaagaaactacccatactaatttttcctgaaggaacttgcatcaacaatacttcagtcatgatgtttaaaaaggggagctttgaaattggaggaaccatacatccagttgcaattaagtataaccctcagttcggtgatgcattttggaacagtagtaaatacaacatggtgagctacctgcttcgaatgatgaccagctgggccatcgtctgtgacgtgtggtacatgccccccatgaccagagaggaaggagaagatgcagtccagtttgctaacagggttaagtctgctattgctatacaaggaggcctgactgaacttccctgggatggaggactaaagagagcaaaggtgaaggacatctttaaggaagagcagcagaaaaattacagcaagatgattgtgggcaatggatctctcagctaagaggacggatgacagcctttagatctagaactagcccttagaaatggaatggctttttttgttttgttttgttttattgttttgtttttattattgttaatcttttctacagaatgattgtctctacctctttatgccagaggcagaacctacaggtgccctttttggcttttgttgttgttgtaacattagccccatggattgtaaggtggtttactgagttaaaacagattctgcttttgtaaaatgatggcatcactgtggactgaatgaaatatttgtatagaaaaaagtgcttgaaaagtgtgtttggaactcatcgatagggtaattctccaaaaatgcccaaactctttttctgtaattagccttgccactttcttcagtcacttaaatggtgagattacacatcagtgcaagatgaccattatggttatggtctactgcaaggttgaaaggaaaaatggaggattgtatttaggaaaagggacaactttgtggccacctgctctgaaagtcaaaaggaaatgtaaattagtgtcattagtgtgttggaagagaaatactattcagtaagcttcgccaaagaaaagtgagtcaaagttaatgtgtgtgcgcatttatatgtaggcagctcgtagaccacattttaaccagcaactggtaacaaagagcttagttttccttgtttgaatgctgtagatctgtacctagtacccctcccatctactgatttgtttgtttttgtaaccaaacacattttcagatagaaggagccttaaaaaaaaaaaatcacattgagtaacttcagtatgaatgaatgagagtgtgtggagctacccctcaccctccacccctttgtgctttttattcccgaattttcccagtctcttaaacagaaaaatgactgatataattatcttttggaaactgagccttaattttttttagagggggaaataagttttccccaactcacacagcataagcaatgtttgacagcaatataatgccgttgtaaactactgagagtattgtatctgttctggtaaccatgtacagaatgtgaaactgtcttatgaatataaataaattctatatttctaaa

SEQ ID NO: 137915 - DNA, 2631 bp, Homo sapiens
  Payload ID: 7008
  Gene Symbol: GPAT3
  Gene Name: glycerol-3-phosphate acyltransferase 3
  Uniprot ID: Q53EU6
  ENST ID: ENST00000395226
  CDS Start-End: 219-1523
agcttccagcacagcccgcggcccggtgccagctccgccggcgaccggtgtgccaaagtgcggtgctcccgcagggaacctggctcggggagggcctccaggtgagtgccgggctcggcgctctgctcctggagctcccgcgggactgcctggggacagggactgctgtggcgctcggccctccactgcggacctctcctgagtgggtgcgccgagtcatggagggcgcagagctggccgggaagatcctttccacctggctgacgctggttctcggcttcatccttttaccttcggtcttcggagtgtctctgggcatctccgagatctacatgaagatcctagtgaaaactttagagtgggccacaatacgaattgaaaaaggaaccccaaaggagtcgattcttaaaaactctgcttctgttggtattatccaaagagatgagtcacccatggaaaaagggctctctggtctacgaggaagggactttgagctgtctgacgtgttttatttctccaagaagggattggaagccattgtagaagatgaagtgacccagaggttttcctcagaggagctagtgtcatggaatctcctcacaagaaccaatgtaaatttccagtacatcagtctgcggctcactatggtgtgggtgctgggcgtcatagtgcgctattgtgtcctactgcctctgagggttaccttggctttcattgggatcagtttgctggttataggaactacactggttgggcagctgccagacagcagcctcaaaaactggctgagtgaactggtccatctgacttgctgccggatctgtgtgcgagccctctctggtaccattcattatcataacaagcagtacagaccccagaagggaggcatttgtgttgccaaccatacttcccccattgatgttttaatcttgacaacggatggatgttatgctatggttggccaggttcatggcggcttgatgggaattattcagagagctatggtcaaggcttgtcctcatgtctggtttgaacgctcagaaatgaaggatcgacacctggttactaagagactaaaagaacatattgctgataagaagaaactacccatactaatttttcctgaaggaacttgcatcaacaatacttcagtcatgatgtttaaaaaggggagctttgaaattggaggaaccatacatccagttgcaattaagtataaccctcagttcggtgatgcattttggaacagtagtaaatacaacatggtgagctacctgcttcgaatgatgaccagctgggccatcgtctgtgacgtgtggtacatgccccccatgaccagagaggaaggagaagatgcagtccagtttgctaacagggttaagtctgctattgctatacaaggaggcctgactgaacttccctgggatggaggactaaagagagcaaaggtgaaggacatctttaaggaagagcagcagaaaaattacagcaagatgattgtgggcaatggatctctcagctaagaggacggatgacagcctttagatctagaactagcccttagaaatggaatggctttttttgttttgttttgttttattgttttgtttttattattgttaatcttttctacagaatgattgtctctacctctttatgccagaggcagaacctacaggtgccctttttggcttttgttgttgttgtaacattagccccatggattgtaaggtggtttactgagttaaaacagattctgcttttgtaaaatgatggcatcactgtggactgaatgaaatatttgtatagaaaaaagtgcttgaaaagtgtgtttggaactcatcgatagggtaattctccaaaaatgcccaaactctttttctgtaattagccttgccactttcttcagtcacttaaatggtgagattacacatcagtgcaagatgaccattatggttatggtctactgcaaggttgaaaggaaaaatggaggattgtatttaggaaaagggacaactttgtggccacctgctctgaaagtcaaaaggaaatgtaaattagtgtcattagtgtgttggaagagaaatactattcagtaagcttcgccaaagaaaagtgagtcaaagttaatgtgtgtgcgcatttatatgtaggcagctcgtagaccacattttaaccagcaactggtaacaaagagcttagttttccttgtttgaatgctgtagatctgtacctagtacccctcccatctactgatttgtttgtttttgtaaccaaacacattttcagatagaaggagccttaaaaaaaaaaaatcacattgagtaacttcagtatgaatgaatgagagtgtgtggagctacccctcaccctccacccctttgtgctttttattcccgaattttcccagtctcttaaacagaaaaatgactgatataattatcttttggaaactgagccttaattttttttagagggggaaataagttttccccaactcacacagcataagcaatgtttgacagcaatataatgccgttgtaaactactgagagtattgtatctgttctggtaaccatgtacagaatgtgaaactgtcttatgaatataaataaattctatatttctaaa

SEQ ID NO: 137916 - DNA, 2633 bp, Homo sapiens
  Payload ID: 7008
  Gene Symbol: GPAT3
  Gene Name: glycerol-3-phosphate acyltransferase 3
  Uniprot ID: Q53EU6
  ENST ID: ENST00000611707
  CDS Start-End: 224-1528
agatgaaaactctcctcctgaaaggacctttgctgagtgctgggggaggcggggcgcggggaagaacggagaccgcccaggaggctgcggcactcctgggctaaaggtgagtgccgggctcggcgctctgctcctggagctcccgcgggactgcctggggacagggactgctgtggcgctcggccctccactgcggacctctcctgagtgggtgcgccgagtcatggagggcgcagagctggccgggaagatcctttccacctggctgacgctggttctcggcttcatccttttaccttcggtcttcggagtgtctctgggcatctccgagatctacatgaagatcctagtgaaaactttagagtgggccacaatacgaattgaaaaaggaaccccaaaggagtcgattcttaaaaactctgcttctgttggtattatccaaagagatgagtcacccatggaaaaagggctctctggtctacgaggaagggactttgagctgtctgacgtgttttatttctccaagaagggattggaagccattgtagaagatgaagtgacccagaggttttcctcagaggagctagtgtcatggaatctcctcacaagaaccaatgtaaatttccagtacatcagtctgcggctcactatggtgtgggtgctgggcgtcatagtgcgctattgtgtcctactgcctctgagggttaccttggctttcattgggatcagtttgctggttataggaactacactggttgggcagctgccagacagcagcctcaaaaactggctgagtgaactggtccatctgacttgctgccggatctgtgtgcgagccctctctggtaccattcattatcataacaagcagtacagaccccagaagggaggcatttgtgttgccaaccatacttcccccattgatgttttaatcttgacaacggatggatgttatgctatggttggccaggttcatggcggcttgatgggaattattcagagagctatggtcaaggcttgtcctcatgtctggtttgaacgctcagaaatgaaggatcgacacctggttactaagagactaaaagaacatattgctgataagaagaaactacccatactaatttttcctgaaggaacttgcatcaacaatacttcagtcatgatgtttaaaaaggggagctttgaaattggaggaaccatacatccagttgcaattaagtataaccctcagttcggtgatgcattttggaacagtagtaaatacaacatggtgagctacctgcttcgaatgatgaccagctgggccatcgtctgtgacgtgtggtacatgccccccatgaccagagaggaaggagaagatgcagtccagtttgctaacagggttaagtctgctattgctatacaaggaggcctgactgaacttccctgggatggaggactaaagagagcaaaggtgaaggacatctttaaggaagagcagcagaaaaattacagcaagatgattgtgggcaatggatctctcagctaagaggacggatgacagcctttagatctagaactagcccttagaaatggaatggctttttttgttttgttttgttttattgttttgtttttattattgttaatcttttctacagaatgattgtctctacctctttatgccagaggcagaacctacaggtgccctttttggcttttgttgttgttgtaacattagccccatggattgtaaggtggtttactgagttaaaacagattctgcttttgtaaaatgatggcatcactgtggactgaatgaaatatttgtatagaaaaaagtgcttgaaaagtgtgtttggaactcatcgatagggtaattctccaaaaatgcccaaactctttttctgtaattagccttgccactttcttcagtcacttaaatggtgagattacacatcagtgcaagatgaccattatggttatggtctactgcaaggttgaaaggaaaaatggaggattgtatttaggaaaagggacaactttgtggccacctgctctgaaagtcaaaaggaaatgtaaattagtgtcattagtgtgttggaagagaaatactattcagtaagcttcgccaaagaaaagtgagtcaaagttaatgtgtgtgcgcatttatatgtaggcagctcgtagaccacattttaaccagcaactggtaacaaagagcttagttttccttgtttgaatgctgtagatctgtacctagtacccctcccatctactgatttgtttgtttttgtaaccaaacacattttcagatagaaggagccttaaaaaaaaaaaatcacattgagtaacttcagtatgaatgaatgagagtgtgtggagctacccctcaccctccacccctttgtgctttttattcccgaattttcccagtctcttaaacagaaaaatgactgatataattatcttttggaaactgagccttaattttttttagagggggaaataagttttccccaactcacacagcataagcaatgtttgacagcaatataatgccgttgtaaactactgagagtattgtatctgttctggtaaccatgtacagaatgtgaaactgtcttatgaatataaataaattctatatttct

SEQ ID NO: 137917 - DNA, 6298 bp, Homo sapiens
  Payload ID: 7009
  Gene Symbol: GPAT4
  Gene Name: glycerol-3-phosphate acyltransferase 4
  Uniprot ID: Q86UL3
  ENST ID: ENST00000396987
  CDS Start-End: 928-2298
gcagcttgggcccgcggcggcggcaagggcgggagggagcggtcgccgcgggatttggagctgcctagcctcgcggtcgctttggcagcatgtaagcagctgtttgccaagaacccaggtcactgctaagaaagggtgccttcgggagaagagtgtccagaggataccaatgccagatgcatctggagttacactcagcactcgcagtatgagacattgtgtgccagcatctctttccttctggcaaagactgtagctctccaggtaggaggatcctggaagctgtgagcaccaggagccttgccagaggaggatggggccagatatgaactctctaccatgaacatggttctcggcttatgaaggaattttaagtaaaacagttatttaatttccacatattcaagtcaaaagccttctgtgtgaagtgccagtgattacccctccacaggagttatcaggatttttctggcaccaagtttaattcttcttcgtacttctggtagtgacagatctgcaggacagatttatctgttgaatgctcttgggcaggaaaaccatgtaaaacctctggaagcagcatcaggacagcagagcagagcccccgtcctcactgctcacttgcacagaaactccatctggactcggatgcttttactgaagacccatctagcttcaatcatctttagagtccatccattctggagagacctggcgtttgcagttgcctcctgtggccgtgtttttctgtcattctgttcccaggccttctattcaggcggttgaagggtgtggactttggaatggggtttgctgttcttcgggaacttgcttcctttccctggctggtgctgtcaggaaggaccatctgaaggctgcaatttgttcttagggaggcaggtgctggcctggcctggatcttccaccatgttcctgttgctgccttttgatagcctgattgtcaaccttctgggcatctccctgactgtcctcttcaccctccttctcgttttcatcatagtgccagccatttttggagtctcctttggtatccgcaaactctacatgaaaagtctgttaaaaatctttgcgtgggctaccttgagaatggagcgaggagccaaggagaagaaccaccagctttacaagccctacaccaacggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgagcagaaccaattataacttccagtacatcagccttcggctcacggtcctgtgggggttaggagtgctgattcggtactgctttctgctgccgctcaggatagcactggctttcacagggattagccttctggtggtgggcacaactgtggtgggatacttgccaaatgggaggtttaaggagttcatgagtaaacatgttcacttaatgtgttaccggatctgcgtgcgagcgctgacagccatcatcacctaccatgacagggaaaacagaccaagaaatggtggcatctgtgtggccaatcatacctcaccgatcgatgtgatcatcttggccagcgatggctattatgccatggtgggtcaagtgcacgggggactcatgggtgtgattcagagagccatggtgaaggcctgcccacacgtctggtttgagcgctcggaagtgaaggatcgccacctggtggctaagagactgactgaacatgtgcaagataaaagcaagctgcctatcctcatcttcccagaaggaacctgcatcaataatacatcggtgatgatgttcaaaaagggaagttttgaaattggagccacagtttaccctgttgctatcaagtatgaccctcaatttggcgatgccttctggaacagcagcaaatacgggatggtgacgtacctgctgcgaatgatgaccagctgggccattgtctgcagcgtgtggtacctgcctcccatgactagagaggcagatgaagatgctgtccagtttgcgaatagggtgaaatctgccattgccaggcagggaggacttgtggacctgctgtgggatgggggcctgaagagggagaaggtgaaggacacgttcaaggaggagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagcctacccttggtggtctaaacggatgctgctgggtgttgcgacccaggacgagatgccttgtttcttttacaataagtcgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacatcgcccccagccttggagctctgcagacatgataggaaggaaactgtcatctgcaggggctttcagcaaaatgaagggttagatttttatgctgctgctgatggggttactaaagggaggggaagaggccaggtgggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatgaactgggggacttctccctttactttctcccctggctgtggccctgagtagcaggcttctcgtgaggattcccgttctcttctgggagcatggccctggggctgcggagaagccaactgactgctggagcgaggaaccctgcagctcagaaggtgaacagctcgtctcagatgcttgcagatctttggttaatttagaatttccagcacagacgtggatttctccagagacggggtgtgtgcgggtcgctgatgtgaggcctaggggaagcaatgagtaaactccagggtgggggaggagcaagggcccggggagggctgcagaggggccggggcggggcagggcctgtgctgcatggtggcttctgcaggggagggacaggggagggctgcagaggggcagggtgggcagggcatgtgctgcatggcagcttctgcacagccagagcaggcaccacaggaaaagagtcggccactggtgcctgctgtacagtcacagtggaggcagagccaaggccaagcagcccctgtgggttctggggtttcaccagtttcatgctcctcagctccccattcatgccccaccagccctcacttgggacccatgctccctcgtggcacagtcatgatgcctctcaggattttgtgcctgtggtgctgagtgtcacgtccccaaggtcgccctctggcctgcagttcagggagtgggtgggagtgaagctgtgctcctggggctgcagacagatccactttgcatgtggtacctgctgggttggccctgcaatctccttttctctgcacctacctgtgacctccctgggagagcctcccatttcctcacctgccctgttgccagcccgggggaaatctttttgctctcaaatgaagactgaaaaaataaagtcagtgttatgactaataagtctcttaggaactgttttacaaaatgcttaagaataaaaagtgattttcagcttttataggtgatgtttacagtgtttgtaaaccaactggagggatcagtaattggtcttaaaagatcaggttctcttttaaaaagttcatctgaaactttatggtttgttactttcgtgatttgcataggtatttatatatacacacacacacaggttttgcttttgtctcacattcagcacagctgtctgcggcccctgccggcaggtgtggccgcacctggtgtgaagtcacgtggagtcagtgctgtggagggaagtcctgtgcgggccgggcagtgaggagagcactgattcacgcctgcagaaacgtaacctcccctttccgtgtatgccttttaccatcatccaggcgactgctccatccttttaaattaggggtcctgcaagccccaagtgacccatagtcagagtatctggtttggggtaaccgagttggtcttatggggcaaaaactcaagacacttagaaacatgcaaagtacaaaataatgtgttccctcctgttaccccagcaagggtggggctgagctgggaatgacacccagtggtgtaatgagtggaaagtgctggtcagctgctaacccccctccaagcctgctgcaccttcacttctctgcatccgtctcctgagtcataactagggacttggctagatgacctcagagacctcgtccacctctgaattctctgtttttaagcccatagttcaaactttggctttgatctctgaagtcttctgggtttggaaatacgggaagtcagctttgaatccattgcttctctaaaacatcagggctagtggaactaacccacttgagggtgacctcaagggctttaggcagccatggggctggggccatactgctctcaggctgggcagtatcttcattgtggttctcagacagccttttttactcaaacatgagactttccacccaccagttagggaactttttttttttttttaaacacggagtttcactcttgttgcccatgctggagtgcaatggcacaatctcagctccactgcaacctctacctcccgggttcaagtgattcttctgcctcagcctccaagtagctgagattacaggcatgcaccaccacacccagctaattttttgtatttagtagagactgggtttcaccatgttggtcaggctggtctccaactcctgacctcaggtgatccactctccttggcctcccaaagttctgggattacaggcgtgagccactgcgcccagccaagagggaactttttaataaagctagtgggattcccttgacagcagaaccagccttgggacttgatgcttcaccgtgtcagaatccgtccctggtgctgcctttcagagaagaggcttgatgtgtgaggggtcagggggagtgctccagatccctgaaatgcccttcccagaccagtgacaggcatttttgggtgccatcgtgtgaccttcacggcacagcaaacagtgggcactaaccctgttgtcctgtggaaatctgggtctctgaatcctgccatttccttcctggaattggccaggaacttgattttctgggctattgcttgctagtgtcccctgatgcatgaaggatccccccatgtcataggtcccacctgcctgctgtgcatcccgggtggccagactcggcttctccaggtgcacttgtcccaggtggcccggtccgtaggctggaagggcagctgcaggtgcactgcctcgcggacaggttaggatatggccacgcagccatccatcttctacagcacgcacaccccactctctcccccagtcaatatgtctctctccgatgggaaagttaataaattttgctctagattaaaagtattgatcatttcatttgtaaacgataaataaaaagggggaacttttcattgcgccaggggtggcacctggcgtgtgttgcgggggtgattgcgctggctgccggggggtgggcttctcatatgcattctggccggccagctgcattgatttcctattagtctcccagcaccacccagtaacacatcatttcagtacctgctattaatggtcttttgataaataatcacttgtaagtcaataaatttttattaaacagtg

SEQ ID NO: 137918 - DNA, 873 bp, Homo sapiens
  Payload ID: 7009
  Gene Symbol: GPAT4
  Gene Name: glycerol-3-phosphate acyltransferase 4
  ENST ID: ENST00000521806
  CDS Start-End: 93-632
ctttccctggctggtgctgtcaggaaggaccatctgaaggctgcaatttgttcttagggaggcaggtgctggcctggcctggatcttccaccatgttcctgttgctgccttttgatagcctgattgtcaaccttctgggcatctccctgactgtcctcttcaccctccttctcgttttcatcatagtgccagccatttttggagtctcctttggtatccgcaaactctacatgaaaagtctgttaaaaatctttgcgtgggctaccttgagaatggagcgaggagccaaggagaagaaccaccagctttacaagccctacaccaacggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgagcagaaccaattataacttccagtacatcagccttcggctcacggtcctgtgggggttaggagtgctgattcggtactgctttctgctgccgctcaggtgaactctggtccaggtcccaggatagcactggctttcacagggattagccttctggtggtgggcacaactgtggtgggatacttgccaaatgggaggtttaaggagttcatgagtaaacatgttcacttaatgtgttaccggatctgcgtgcgagcgctgacagccatcatcacctaccatgacagggaaaacagaccaagaaatggtggcatctgtgtggccaatcatacctcaccgatcga

SEQ ID NO: 137919 - DNA, 1101 bp, Homo sapiens
  Payload ID: 7009
  Gene Symbol: GPAT4
  Gene Name: glycerol-3-phosphate acyltransferase 4
  ENST ID: ENST00000520223
  CDS Start-End: 1015-1101
aggaggcaccatcgccgcgccccggggatccccggcgggtggagcgggtgccccccgtccgggatggaacggtccgcgcccgccccgaaccccggccgcccgcctctccgctcgcctgctctccgagcccggctcctcggagcccctcgcctcccccaagtcccagctttggcagcatgtaagcagctgtttgccaagaacccaggtcactgctaagaaagggtgccttcgggagaagagtgtccagaggataccaatgccagatgcatctggagttacactcagcactcgcagtatgagacattgtgtgccagcatctctttccttctggcaaagactgtagctctccaggtaggaggatcctggaagctgtgagcaccaggagccttgccagaggaggatggggccagatatgaactctctaccatgaacatggttctcggcttatgaaggaattttaagtaaaacagttatttaatttccacatattcaagtcaaaagccttctgtgtgaagtgccagtgattacccctccacaggagttatcaggatttttctggcaccaagtttaattcttcttcgtacttctggtagtgacagatctgcaggacagatttatctgttgaatgctcttgggcaggaaaaccatgtaaaacctctggaagcagcatcaggacagcagagcagagcccccgtcctcactgctcacttgcacagaaactccatctggactcggatgcttttactgaagacccatctagcttcaatcatctttagagtccatccattctggagagacctggcgtttgcagttgcctcctgtggccgtgtttttctgtcattctgttcccaggccttctattcaggcggttgaagggtgtggactttggaatggggtttgctgttcttcgggaacttgcttcctttccctggctggtgctgtcaggaaggaccatctgaaggctgcaatttgttcttagggaggcaggtgctggcctggcctggatcttccaccatgttcctgttgctgccttttgatagcctgattgtcaaccttctgggcatctccctgactgtcctcttcaccctccttctcgttttc

SEQ ID NO: 137920 - DNA, 768 bp, Homo sapiens
  Payload ID: 7009
  Gene Symbol: GPAT4
  Gene Name: glycerol-3-phosphate acyltransferase 4
  ENST ID: ENST00000519853
  CDS Start-End: 294-768
ggcggcggcaagggcgggagggagcggtcgccgcgggatttggagctgcctagcctcgcggtcgctttggcagcatgtaagcagctgtttgccaagaacccaggtcactgctaagaaagggtgccttcgggagaagagtgtccagaggataccaatgccagatgcatctggagttacactcagcactcgcagtatgagacattgtgtgccagcatctctttccttctggcaaagactgtagctctccagtgccagccatttttggagtctcctttggtatccgcaaactctacatgaaaagtctgttaaaaatctttgcgtgggctaccttgagaatggagcgaggagccaaggagaagaaccaccagctttacaagccctacaccaacggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgagcagaaccaattataacttccagtacatcagccttcggctcacggtcctgtgggggttaggagtgctgattcggtactgctttctgctgccgctcaggatagcactggctttcacagggattagccttctggtggtgggcacaactgtggtgggatacttgccaaatgggaggt

SEQ ID NO: 137921 - DNA, 6371 bp, Homo sapiens
  Payload ID: 7010
  Gene Symbol: GPAM
  Gene Name: glycerol-3-phosphate acyltransferase, mitochondrial
  Uniprot ID: Q9HCL2
  ENST ID: ENST00000348367
  CDS Start-End: 199-2685
gccactgcagctggcattggccgggactggaagtgcgggcttctgcagcagccgaagctggagctgctagggcagcagcggctcccctgttgtatggacattctgcacccgaaactgatagctgagtcctgaagttttatgttatgaaacagaagaactttcatcccagcacatgatttgggaattacactttgtgacatggatgaatctgcactgacccttggtacaatagatgtttcttatctgccacattcatcagaatacagtgttggtcgatgtaagcacacaagtgaggaatggggtgagtgtggctttagacccaccatcttcagatctgcaactttaaaatggaaagaaagcctaatgagtcggaaaaggccatttgttggaagatgttgttactcctgcactccccagagctgggacaaatttttcaaccccagtatcccgtctttgggtttgcggaatgttatttatatcaatgaaactcacacaagacaccgcggatggcttgcaagacgcctttcttacgttctttttattcaagagcgagatgtgcataagggcatgtttgccaccaatgtgactgaaaatgtgctgaacagcagtagagtacaagaggcaattgcagaagtggctgctgaattaaaccctgatggttctgcccagcagcaatcaaaagccgttaacaaagtgaaaaagaaagctaaaaggattcttcaagaaatggttgccactgtctcaccggcaatgatcagactgactgggtgggtgctgctaaaactgttcaacagcttcttttggaacattcaaattcacaaaggtcaacttgagatggttaaagctgcaactgagacgaatttgccgcttctgtttctaccagttcatagatcccatattgactatctgctgctcactttcattctcttctgccataacatcaaagcaccatacattgcttcaggcaataatctcaacatcccaatcttcagtaccttgatccataagcttgggggcttcttcatacgacgaaggctcgatgaaacaccagatggacggaaagatgttctctatagagctttgctccatgggcatatagttgaattacttcgacagcagcaattcttggagatcttcctggaaggcacacgttctaggagtggaaaaacctcttgtgctcgggcaggacttttgtcagttgtggtagatactctgtctaccaatgtcatcccagacatcttgataatacctgttggaatctcctatgatcgcattatcgaaggtcactacaatggtgaacaactgggcaaacctaagaagaatgagagcctgtggagtgtagcaagaggtgttattagaatgttacgaaaaaactatggttgtgtccgagtggattttgcacagccattttccttaaaggaatatttagaaagccaaagtcagaaaccggtgtctgctctactttccctggagcaagcgttgttaccagctatacttccttcaagacccagtgatgctgctgatgaaggtagagacacgtccattaatgagtccagaaatgcaacagatgaatccctacgaaggaggttgattgcaaatctggctgagcatattctattcactgctagcaagtcctgtgccattatgtccacacacattgtggcttgcctgctcctctacagacacaggcagggaattgatctctccacattggtcgaagacttctttgtgatgaaagaggaagtcctggctcgtgattttgacctggggttctcaggaaattcagaagatgtagtaatgcatgccatacagctgctgggaaattgtgtcacaatcacccacactagcaggaacgatgagttttttatcacccccagcacaactgtcccatcagtcttcgaactcaacttctacagcaatggggtacttcatgtctttatcatggaggccatcatagcttgcagcctttatgcagttctgaacaagaggggactggggggtcccactagcaccccacctaacctgatcagccaggagcagctggtgcggaaggcggccagcctgtgctaccttctctccaatgaaggcaccatctcactgccttgccagacattttaccaagtctgccatgaaacagtaggaaagtttatccagtatggcattcttacagtggcagagcacgatgaccaggaagatatcagtcctagtcttgctgagcagcagtgggacaagaagcttccagaacctttgtcttggagaagtgatgaagaagatgaagacagtgactttggggaggaacagcgagattgctacctgaaggtgagccaatccaaggagcaccagcagtttatcaccttcttacagagactccttgggcctttgctggaggcctacagctctgctgccatctttgttcacaacttcagtggtcctgttccagaacctgagtatctgcaaaagttgcacaaatacctaataaccagaacagaaagaaatgttgcagtatatgctgagagtgccacatattgtcttgtgaagaatgctgtgaaaatgtttaaggatattggggttttcaaggagaccaaacaaaagagagtgtctgttttagaactgagcagcacttttctacctcaatgcaaccgacaaaaacttctagaatatattctgagttttgtggtgctgtaggtaacgtgtggcactgctggcaaatgaaggtcatgagatgagttccttgtaggtaccagcttctggctcaagagttgaaggtgccatcgcagggtcaggcctgccctgtcccgaagtgatctcctggaagacaagtgccttctccctccatggatctgtgatcttcccagctctgcatcaacacagcagcctgcagataacacttggggggacctcagcctctattcgcaactcataatccgtagactacaagatgaaatctcaataaattatttttgagtttattaaagattgacattttaagtacaacttttaaggactaattactgtgatggacacagaaatgtagctgtgttctggaactgaatcttacatggtatacttagtgctgctgggtaatttgttggtatattatctggttagtggttaatgcttcctttaaaaataattgagtcatccattcactctttttcagttttatctgtcaatagtagctacatttttaatgggagcaccttttatcccaaagtgctttataaattgagtggactgatatatatcacacccaggtatcactgtgctgtcctttgctgtcagatttagaaatgtttttaagagctatgtgaaaacagacaatattagtttaggtcgggaactgagatattgtaatcaaatagttaacatcaggaagttaatttggctggcaaaattctagggaaacttggccagaaaactggtgttgaaggcttttgctcatataaacaagtgccattgagtttcaaatgaccagcaaatatatttagaacccttcctgttttatgtctgtacctcgtccacccctcaggtaatacctgcctctcacaggtacagctgtttcttggaaatcctccaaccaaatagcagttttcctaacttgattagcttgagctgacagactgttagaatacagttctctggccacagctgatgagggctttctgtactgcacacagattgtgtactgcaccccagtccaggtgactggtacccactcgagttgtgccgtgcacaacctgtccagtatatgcatgtggtggccctactgactggtaatggttagaggcatttatggatttttagctttgaggaaaaaccatgacttttaacaaatttttatgggttatatgcctaaacccttatgccacatagtggtaaataattatgaaaaatggtctgttcataattggtaggtgccttttgtgagcagggagcataattattggtttattatggtaattatggtgattttttaaatatcatgtaatgttaaaacgttttctaacagtttactgttgcttatctccaagatattatggaattaagaatttttccagatgagtgttacatagattctttgaatttagtataaaagtactgagaattaagtttgtacttccataagcttggattttaaacactgatagtatctcatgagtaatgtgtgttttgggagagggagggatgctgattgatatttcacattgtatgaaataccatgtttgaaactcatagcaataatgctatgctgttgtgatccctctcaagttctgcatttaaaatatattttttctttataggaattgatgtataccatgaagtcattgtcagttgtagtagctctgatgttgaatgagatatcatgttttagcattccattttactgactagggtagaagaacacttttcttggctacatttggaggatacccagggagtcttgggtgttccttatctggggaagcaaacatttcactagtctctttttttcatcctttaaattgtaaattaaggattactcaagctcaccattattcaagattgggactcgcttcccagtcgacactctgccctgcctgtcattgctgcaaagagctgctgctttgccaacctaagcaaagaaaatacggcttctcttgcattattttcccttttggttggtttgttttctagaagtacgttcagatgctttggggaatgcaatgtatgatttgctagctctctcaccacttaactcactgtgaggataaatatgcatgctttttgtaattaactggtgctttgaaaatcttttttaagggagaaaaatctcaaccaaagttatgctcatccagacaagctgacctttgagttaatttcagcacaactcattcttcagtgcctcatgactgaaaacaaaaaacaaaaaaacgaaagcatcttcacaatgaagcttccagatagcaccgttttgctaaaagatacattctcattgttttccaacagtgatggcttccacataaggttaaacaaactaggtgcttgtaaataatttattacagtttactctatcgcatttctgtaacatgaaatgcatgcccttcttcaggggaagactgtggtcaagttaaaaaaaaaaaacaatattaaacaacatgaaactgcagtctgtttttgaaaatgagaatgtcctaagtgattcagaagagaggagggaagttgtgcactctgaaaatgcatgaaaaacaaaggcaaaaactagtgggaaatgtgtagaactgttaactgagatggcttcgagtcttccttctggaatctgttaaatttcacaaagtcatgagggtaaatggagaaaatatttctgggattacaatgaatgtaagcccaaattgtggaattgccagtaacctggatggggaaaagcatttcccatagcactccatgtaatatgagtgctctgtgagatgttcatcagtgttttatagaaatggtgttgctgggaaaccaagtttgcacctggaaacttacaatgcactttagcgcagtaagggcttggcatccggtagtgaaaaactgtctaacccagcattgcccaaactattttgacaccaggacctttttctcctttgggatacttatgaacctctcactaatgtcctgtggagaacattttgggaaacactatgttagatagttctttaaggagacaaaacggtaatgaacagatagcactggggcagaatatgcatgcattttgtaacgtccagtgtggcgttgaatagatgtgtatttcctcccctgcagaaaataagcacagaaaattataatgtaggtgatcggagctctttcctttgatagagagaacagccccaatgatcctggctttttcactgaacgtatcagaatacatggatgaattggggtaaataaggttttaattcagatctagaagaaagtattgtacgtttgaatgcagatttttatccacagatagttgtagtgtttagacatgacaggacctatcgttgaggtttctaagacttactatgggctgtaaacctgttttttaaaactattttagaaacctgagacttgccgtctggcattttagtttaatacaaactaatgattgcatttgaaagagattcttgaccttatttctaaacgtctagagctctgaaatgtcttgatggaaggtattaaactatttgcctgttgtacaaagaaatgttaagactcgtgaaaagaattactataaggtactgtgaaataactgcgattttgtgagcaaaacatacttggaaatgctgattgatttttatgcttgttagtgtattgcaagaaacacagaaaatgtagttttgttttaataaaccaaaaattgaacatac

SEQ ID NO: 137922 - DNA, 5664 bp, Homo sapiens
  Payload ID: 7010
  Gene Symbol: GPAM
  Gene Name: glycerol-3-phosphate acyltransferase, mitochondrial
  ENST ID: ENST00000369425
  CDS Start-End: 165-2297
gaagctggagctgctagggtgcgaactgccagggcaggcagcagcggctcccctgttgtatggacattctgcacccgaaactgatagctgagtcctgaagttttatgttatgaaacagaagaactttcatcccagcacatgatttgggaattacactttgtgacatggatgaatctgcactgacccttggtacaatagatgtttcttatctgccacattcatcagaatacagtgttggtcgatgtaagcacacaagtgaggaatggggtgagtgtggctttagacccaccatcttcagatctgcaactttaaaatggaaagaaagcctaatgagtcggaaaaggccatttgttggaagatgttgttactcctgcactccccagagctgggacaaatttttcaaccccagtatcccgtctttgggtttgcggaatgttatttatatcaatgaaactcacacaagacaccgcggatggcttgcaagacgcctttcttacgttctttttattcaagagcgagatgtgcataagggcatgtttgccaccaatgtgactgaaaatgtgctgaacagcagtagagtacaagaggcaattgcagaagtggctgctgaattaaaccctgatggttctgcccagcagcaatcaaaagccgttaacaaagtgaaaaagaaagctaaaaggattcttcaagaaatggttgccactgtctcaccggcaatgatcagactgactgggtgggtgctgctaaaactgttcaacagcttcttttggaacattcaaattcacaaaggtcaacttgagatggttaaagctgcaactgagacgaatttgccgcttctgtttctaccagttcatagatcccatattgactatctgctgctcactttcattctcttctgccataacatcaaagcaccatacattgcttcaggcaataatctcaacatcccaatcttcagtaccttgatccataagcttgggggcttcttcatacgacgaaggctcgatgaaacaccagatggacggaaagatgttctctatagagctttgctccatgggcatatagttgaattacttcgacagcagcaattcttggagatcttcctggaaggcacacgttctaggagtggaaaaacctcttgtgctcgggcaggacttttgtcagttgtggtagatactctgtctaccaatgtcatcccagacatcttgataatacctgttggaatctcctatgatcgcattatcgaaggtcactacaatggtgaacaactgggcaaacctaagaagaatgagagcctgtggagtgtagcaagaggtgttattagaatgttacgaaaaaactatggttgtgtccgagtggattttgcacagccattttccttaaaggaatatttagaaagccaaagtcagaaaccggtgtctgctctactttccctggagcaagcgttgttaccagctatacttccttcaagacccagtgatgctgctgatgaaggtagagacacgtccattaatgagtccagaaatgcaacagatgaatccctacgaaggaggttgattgcaaatctggctgagcatattctattcactgctagcaagtcctgtgccattatgtccacacacattgtggcttgcctgctcctctacagacacaggcagggaattgatctctccacattggtcgaagacttctttgtgatgaaagaggaagtcctggctcgtgattttgacctggggttctcaggaaattcagaagatgtagtaatgcatgccatacagctgctgggaaattgtgtcacaatcacccacactagcaggaacgatgagttttttatcacccccagcacaactgtcccatcagtcttcgaactcaacttctacagcaatggggtacttcatgtctttatcatggaggccatcatagcttgcagcctttatgcagttctgaacaagaggggactggggggtcccactagcaccccacctaacctgatcagccaggagcagctggtgcggaaggcggccagcctgtgctaccttctctccaatgaaggcaccatctcactgccttgccagacattttaccaagtctgccatgaaacagtaggaaagtttatccagtatggcattcttacagtggcagagcacgatgaccaggaagatatcagtcctagtcttgctgagcagcagtgggacaagaagcttccagaacctttgtcttggagaagtgatgaagaagatgaagacagtgactttggggaggaacagcgagattgctacctgaaggtacttgggtgaagaattctggtggatattacagggatatgttgaggtttatgctgcagtgagatcagctggagtcctggtgatgtcttcttatctaaagaatcccccaactagctctggtaccttctgtgtggtaaagacactcaaactgtttgagttgaattaatagcattttaagtagaaaaggaaaggagagtctgaaaagtcaggaagatgaatgtcataggtgagactttcaccatccttttatgaaatacacaggtgcatacctgtttacctacacctgcacccctcatgaggcagcagttttgctattgagctgccactgacctggctgctctttttgagtcactcttgctgtccctcccaaaatttcatatattaagctctttgctgtcaattaaaacaaataccattataggagaaaattgagattaaaaaaaaagtccctgatttagaaaaatcaattttgtctaatttataattttagaacttagtaataatgacccgtcttttctgaatactctaagaggattactcttttttgacatttagaaattgtcttctttttcacttgggtggtattagtttagtttcaagatggggcagtgatcttgctttcacactccagaggggcttgaccgaaccagtgtgttttgggtaggtacagtgagagcctctcggccataaagcaccgccgtcacagtggccatcattccccacagtgctggactgtgggcaaaggccatttaggggaggcagggaataggtgctgcagaaggagtgagataatcttggtggtctcccattggtctttctgcagacttgagtgactgttgagcccaggcttcaaaccatggagggcctggtcttaggagcggctatttttagtgatgacagcgtatcacaagtagggcattcatttatgaaaatttcttctaggtggctgttcaatgaacacaagcctcaaataccataaaaaagtgaatgattacaataaagaatgtgtttgaaagccagcagttgtttccagcagagattctctgcatgaggggcagggggccgctttcatgtagtgctgatgtgagtggccatcttctcacgttactggctctccagagaaagtcctctgtccacttgccttgtgtctcttgtcccttcctcatgacttcatctcctgcttttgcacactcaggtgagccaatccaaggagcaccagcagtttatcaccttcttacagagactccttgggcctttgctggaggcctacagctctgctgccatctttgttcacaacttcagtggtcctgttccagaacctgagtatctgcaaaagttgcacaaatacctaataaccagaacagaaagaaatgttgcagtatatggtatgttaagtcactatttattcttttaaaatcttttttttttttttggatttcagaaatttgctaattgtagaaaattggaaaaatgcaaacttatcctgacctctaacaccgtagagtattactattatcttctttggcatgttatataagttgaatgatacagttatacactcttacatctggcttttttcacgtaacgttatttttgagattcatacatgttgcatatagttgttcctttgttcttgttgtgtagtgttccattgtataaatatttaccacattttattcattctgctgttgatggatatttgggttgttttcagttcacagctgctttgaacagtgttgctatgagcatatttgaatatgtcttttggtgaatatctgtgcccctatatacagcatgtatgtgggaacagaattgcctggttgtaggctctgggtatattcggctttggtagataccaccaaacagtttccaagggattatacctacttgtactcccacaacagtgtgtgtttcacttgctgcacatcttggccagcgctccgtcttctttgttttaggaggtgtgattggggtgggagtactattttatacagttgtagtttggagctgaaactacttgaatcactttttagagccaaaaggaatctaatctaatcacctcattttatagttgaggaaaataccccaggtcacactgctaattaatgggtaatctcgggatcagaattcttgtttcctaacctcgaggcctgtgctttctctggttccactgatgtacaatcatctgtgtaccactgggtagcttaaagaatatttatacactatctcatttgattctcacaacagtcctggaaaatggatgttttaggtatttctacttccctctgttctccctatttctctctctacaccctcttttctttccccttccctttcttatttacctcaatataggacaaagtaggtgtaagcaaagtaggtttaacagcaagtcatctgagaactcacaggttgccagtggtggaagtggggccccacccttgtctgctgacttgccctcattctcttcctagctccccatactttcttactgtggctgctgggattgtcatgatttgttgagcgtaaccatttgacagggttttattctctctcttcagctgagagtgccacatattgtcttgtgaagaatgctgtgaaaatgtttaaggatattggggtaggtgtccaccatttatggtataaaagctatctcaacttctgttctctttagatctagtctgtttgagctacctttgtggtggggtggaccccgagagaagcagtttctgctggcttaatgataaaggcatttttgggaacggggcatgtaggatgggttgggctatgttgaaggtgaagcccatcagtgtagatttatttgaatgttctggaattttactggtttcacatttattcccaagctgctatatataactggtatcaatatgtttcaaggtgctacaggttgaatatcccttatccaaaatgttgggaccagaaatgttttggatttcagatttttttgggattttggaatatgtgcattagacttacaggttgagcgtctctaatccaaaacccaaaatgctctgatgagcatgtcttttgagcatcatattgatgttcaaaatctttcagattttggagtacttcagatttttgattttgggattaggaccacaatcttggctcttaattattccatatgatttttagttactttcttgtatttttacaagaatttctagaagtatcctcaggtgtcctttaccttcatgattcatggggaatgtaagttctatagagatactagcggccttttgtgagggactgtttgtgactttattctaagtcattttagagtatagttatgttggttgaaattttagaatatagttaatgttggttgaactccatcaaaacaaaaaaaaaaaaa

SEQ ID NO: 137923 - DNA, 3082 bp, Homo sapiens
  Payload ID: 7011
  Gene Symbol: GPD1
  Gene Name: glycerol-3-phosphate dehydrogenase 1 (soluble)
  Uniprot ID: P21695
  ENST ID: ENST00000301149
  CDS Start-End: 233-1282
agaaaaagctgggcctagtctctgccccattcctgttccacacctgtctgtacccctgtctctcctttccctggctctgccagactctctatctccctgggcgccagcctccccacccacccctggagggcggggcttggctgcacccacgtgtggtggagttaaatgctcctagccggcagaggagctagggagtgtggcactgagccggctcaggcagagacgcggcaccatggctagcaagaaagtctgcattgtaggctccgggaactggggctcagccatcgccaagatcgtgggtggcaatgcagcccagctggcacagtttgacccacgggtgaccatgtgggtatttgaggaagacattggaggcaaaaagctgactgagatcatcaacacgcagcatgagaatgtcaaatacctgccagggcacaagttgcccccaaatgtggtggctgtcccagatgtggtccaggctgcagaggatgctgacatcctgatctttgtggtgccccatcagttcatcggcaagatctgtgaccagctcaagggccatctgaaggcaaacgccactggcatatctcttattaagggggtagacgagggccccaatgggctgaagctcatctcggaagtgattggggagcgcctcggcatccccatgagtgtgctgatgggggccaacattgccagcgaggtggctgatgagaagttctgtgagacaaccattggctgcaaggacccggcccagggacaactcctgaaagagctgatgcagacaccaaacttccgtatcacagtggtgcaagaggtggacacagtagagatctgtggagccttaaagaatgtagtggccgtgggggctggcttctgtgatggcctgggctttggcgacaacaccaaggcggcagtgatccggctgggactcatggagatgatagccttcgccaagctcttctgcagtggccctgtgtcctctgccaccttcttggagagctgtggtgttgctgacctgatcactacctgctatggagggcggaaccggaaagtggctgaggcctttgcgcgtacaggaaagtccattgagcagctggagaaagagttgctgaatgggcagaaactgcaggggcccgagacagcccgggagctatacagcatcctccagcacaagggcctggtagacaagtttcccttgttcatggctgtgtacaaggtgtgctacgagggccagccagtgggtgaattcatccactgcctgcagaatcatccagaacatatgtgagtggggccagggcccaggccaggccgcttttttaccccagtggagaccagcagaagcctggggtacctagtcaccaggatctccaggactcccagggagcagagtcttctcatcttttcactggaggacaggaggctatggggcccagctacgcacctggagatcctgaactgtcaagccactggcagcctcatgccaccacatttgccagaaatgcagttgccctgtccctctccagatgtggggctttctccatatcctctgggaggggtggaatcaagccccagtgctgcctgcttggtggcgggggtgatgtatgtggagaagggttgggggagaggccggtagggcaggggctgctagtggctgtctcacatacaccagtaatcctgttaaagggctgaagaagtatcttagccacaggagcgatgaggcaaggattgtcagggaggggtctgggcttctgagctgatgcaggccccaaggacccctttgctgacctctgccaggacccacacagcttcgatggatctcagtgtttgttaacaaaatacaaagatctcaaacaaaccccttttagcttctcctagcaacatctgtgtcctcagaaacctctggttctcccccttccccctcccccaggctgccctggcacccaaattgctgccatgctggcatctgtagctcggtggcttgacattctccccagggacttcccggttcctagttctttgccagctcctccccactctgtgcgacctttccaagccttccctcaccctccccgccagcaccctctttggggagcaggaacttaatctgctgacagagctacacctttcataacaggctcagatcactcagctccctgtgacctttgtattcacccaggcttccttctcagtagctctagctgggggaggtgtcagctgggcccctcctgtgctatctccccagaggacatccctgactccacccctttcttcctcccaaactctgcacctcttcctcagctgctccagaccggccagggtaaccagctaaccatgcctggcatctggaagccagcaggccagagggtggcccaaaggctgatgaacggtagggaagggtgagcagattcctatgttggtgggcaccaatattccaagggcagctctctttgctgaatgagggccttctcgtgaggtactgacaacaccagcaactcgagagctgggaaactcaaggaggaggaagaaaatcaaaaccaccctactccctggggtgaggaaagaacaggaggggaggaggaggagtgtgctctgcacttgccttgctccaggatggggtggcagcagaggaatgtcacaggtcagcagcctaggcctccagctataaatagtccggagggcccgagaggctcccgcccgtccagcagggctgtcagcttcctgtgtggcagcacctggcacactggctctggccagcattatgctaaaaccctgttactctccaatgaaccagggaggcgggctcctctctgcgcctatcccttgagaattctgtcttaccagtgaagggtggggctgcccagatcaggcagcaggagtgaggggcacagtcaccccaggccttgctgagcccaggtctgggtactgagtgtccagagctgcctccccaggaggttaaggtgggggcaaaggggaagcttcaagcactttgcctacttttgttcactccccagtgcactgtgactcaggccttcccatcaggcctatttgtctacccaataaagcgtgttttttccagaaacaagaa

SEQ ID NO: 137924 - DNA, 1591 bp, Homo sapiens
  Payload ID: 7011
  Gene Symbol: GPD1
  Gene Name: glycerol-3-phosphate dehydrogenase 1 (soluble)
  Uniprot ID: P21695
  ENST ID: ENST00000548814
  CDS Start-End: 44-1024
agggagtgtggcactgagccggctcaggcagagacgcggcaccatggctagcaagaaagtctgcattgtaggctccgggaactggggctcagccatcgccaagatcgtgggtggcaatgcagcccagctggcacagtttgacccacgggtgaccatgtgggtatttgaggaagacattggaggcaaaaagctgactgagatcatcaacacgcagcatgagaatgtcaaatacctgccagggcacaagttgcccccaaatgtgttcatcggcaagatctgtgaccagctcaagggccatctgaaggcaaacgccactggcatatctcttattaagggggtagacgagggccccaatgggctgaagctcatctcggaagtgattggggagcgcctcggcatccccatgagtgtgctgatgggggccaacattgccagcgaggtggctgatgagaagttctgtgagacaaccattggctgcaaggacccggcccagggacaactcctgaaagagctgatgcagacaccaaacttccgtatcacagtggtgcaagaggtggacacagtagagatctgtggagccttaaagaatgtagtggccgtgggggctggcttctgtgatggcctgggctttggcgacaacaccaaggcggcagtgatccggctgggactcatggagatgatagccttcgccaagctcttctgcagtggccctgtgtcctctgccaccttcttggagagctgtggtgttgctgacctgatcactacctgctatggagggcggaaccggaaagtggctgaggcctttgcgcgtacaggaaagtccattgagcagctggagaaagagttgctgaatgggcagaaactgcaggggcccgagacagcccgggagctatacagcatcctccagcacaagggcctggtagacaagtttcccttgttcatggctgtgtacaaggtgtgctacgagggccagccagtgggtgaattcatccactgcctgcagaatcatccagaacatatgtgagtggggccagggcccaggccaggccgcttttttaccccagtggagaccagcagaagcctggggtacctagtcaccaggatctccaggactcccagggagcagagtcttctcatcttttcactggaggacaggaggctatggggcccagctacgcacctggagatcctgaactgtcaagccactggcagcctcatgccaccacatttgccagaaatgcagttgccctgtccctctccagatgtggggctttctccatatcctctgggaggggtggaatcaagccccagtgctgcctgcttggtggcgggggtgatgtatgtggagaagggttgggggagaggccggtagggcaggggctgctagtggctgtctcacatacaccagtaatcctgttaaagggctgaagaagtatcttagccacaggagcgatgaggcaaggattgtcagggaggggtctgggcttctgagctgatgcaggccccaaggacccctttgctgacctctgccaggacccacacagcttcgatggatctcagtgtttgttaacaaaatacaaagatctcaaac

SEQ ID NO: 137925 - DNA, 573 bp, Homo sapiens
  Payload ID: 7011
  Gene Symbol: GPD1
  Gene Name: glycerol-3-phosphate dehydrogenase 1 (soluble)
  ENST ID: ENST00000547964
  CDS Start-End: 70-222
aaatgctcctagccggcagaggagctagggagtgtggcactgagccggctcaggcagagacgcggcaccatggctagcaagaaagtctgcattgtaggctccgggaactggtcactggggactatttgtcatgggagtggaggtgataaggaaggggctcagccatcgccaagatcgtgggtggcaatgcagcccagctggcacagtttgacccacgggtgaccatgtgggtatttgaggaagacattggaggcaaaaagctgactgagatcatcaacacgcagcatgagaatgtcaaatacctgccagggcacaagttgcccccaaatgtggtggctgtcccagatgtggtccaggctgcagaggatgctgacatcctgatctttgtggtgccccatcagttcatcggcaagatctgtgaccagctcaagggccatctgaaggcaaacgccactggcatatctcttattaagggggtagacgagggccccaatgggctgaagctcatctcggaagtgattggggagcgcctcggcatccccatgagtgtgctgatgggggccaacattgcca

SEQ ID NO: 137926 - DNA, 4060 bp, Homo sapiens
  Payload ID: 7012
  Gene Symbol: GPD1L
  Gene Name: glycerol-3-phosphate dehydrogenase 1-like
  Uniprot ID: Q8N335
  ENST ID: ENST00000282541
  CDS Start-End: 202-1257
gcagtggttcttgggagtggcgaagcgggtcctgccccgctgtcagctgcggcccccggcgccgggcgggggtggccgcgaccattggcggagaggcgaaaggggcggggccgccgccagccgctgcgggcaaggctgaacaggcggaggtgggcagccggccagggaagcacggtccaggcggctacattcggcccggccatggcagcggcgcccctgaaagtgtgcatcgtgggctcggggaactggggttcagctgttgcaaaaataattggtaataatgtcaagaaacttcagaaatttgcctccacagtcaagatgtgggtctttgaagaaacagtgaatggcagaaaactgacagacatcataaataatgaccatgaaaatgtaaaatatcttcctggacacaagctgccagaaaatgtggttgccatgtcaaatcttagcgaggctgtgcaggatgcagacctgctggtgtttgtcattccccaccagttcattcacagaatctgtgatgagatcactgggagagtgcccaagaaagcgctgggaatcaccctcatcaagggcatagacgagggccccgaggggctgaagctcatttctgacatcatccgtgagaagatgggtattgacatcagtgtgctgatgggagccaacattgccaatgaggtggctgcagagaagttctgtgagaccaccatcggcagcaaagtaatggagaacggccttctcttcaaagaacttctgcagactccaaattttcgaattaccgtggttgatgatgcagacactgttgaactctgtggtgcgcttaagaacatcgtagctgtgggagctgggttctgcgacggcctccgctgtggagacaacaccaaagcggccgtcatccgcctgggactcatggaaatgattgcttttgccaggatcttctgcaaaggccaagtgtctacagccaccttcctagagagctgcggggtggccgacctgatcaccacctgttacggagggcggaaccgcagggtggccgaggccttcgccagaactgggaagaccattgaagagttggagaaggagatgctgaatgggcaaaagctccaaggaccgcagacttctgctgaagtgtaccgcatcctcaaacagaagggactactggacaagtttccattgtttactgcagtgtatcagatctgctacgaaagcagaccagttcaagagatgttgtcttgtcttcagagccatccagagcatacataaagtgaatcatgcaacgtgttgggggaagttctgcctttctgatcaatcttttgggttcacgtggaaaccaggacttggcaacatgatgtttgactgtaatctcatcacggatatgtatgaatttttacaggttcgtttttgaattgtgagaggcagttcattagcaaagatgtactgggcagtaactaaacacacatgcaaacatgtgaatggtggtttattcctcattctgtggatgtttctatgagccaaaatttgatgtctttttttcaaaattgcttatgaaatttccacacaatcgtagcttataagattggaacgatctcagccaaatattttaggtgtaattcatatgtatttgagtggaggattttttttctcatttttctagtgttaaattttaaccagcattaacatggtagagtggaggagtgagtgtgttcaaagatcaacatatttaacttttaaacactatctcaaagccagcataattaactactttgattgtgggctgacctttgtttttttaacaatcaggcatttttaattagataatccactcatgtatttccccctcactgcagttgtctgcatttttagcctcttttctcttcgttagttgtcagaatatgccttcgtcaaggctcagaggtaacaagacagaaaattcatctgggattttcctgctgtggctggcacattcttctgattaacagacacttgtatgatgctttaggctagttagtgcattttttagcaaacatttatcttaaacatcacagatccactggggggtgcaaggggctactgttagtcctcttgttagatgcagtcactcctcctggtcacctagtgagcagggacagagccaggagtcaagtgcagtgccaaggtgcatgaccctctgagaagtcactgggctgatttgacctccgactcattggttgtgcaaatgccatgtgcagcctttcctgaggccataggagggcttcctgcagctgagatctatgcaggccatcctctcaacaagtgccactccaagggcggtcctcggtgcagcagcatcagcttcacttgtgggggggtgggggaaggggcggtctcagaaatgcaggttcccaggtcccaccctggacttctgaaggggtgtggcatctgtgtttctgatgcttactacaatatgtgaaccactactttagaaaatctgctttaacttggtattcctctaattgtgttccctaggaaatgactgtcccaagagccagtgattattccaggtgttccctggaaaggtcaagtgagtctgggaaacactatgtctgtacacctcttgaaggtgtcgaatgtatgtttatacatcagtggaacccatttttctagcctagcaagtcccaaacacattacactgaagagattttggtgaggaaacttgctggagttttcagggaacactgttctaggcttaggtgaccttaggatcactcaagtagacccttcactccctgcgagaaattaggatgaataactacctgtggcattgttggttctgaacttttacagttcaggcctgctgtgaatctttgatgaagctttaaggtgacactgttgtacaagatgtcagctttgctgaaacgcacattacctggaataagtgctttaattgtagaattagaatgggatttactgtactgttttaaatgagattggcttcagaatccattacagttaccttacatagcacttgatacgtgttaaatgaacatatgaatgtaatttatatattcctagaatttaagttactttgtgagatttgggcctgtccctcaatgccagtttaggatttctttttttctataccttgaaatgattataaaatagattttcatgggaattttaaaaactctatccaaaacatttttggagcattttaaagccccatacacagaagtatacgaaagcacacaaaacactccaagtttcagcagttttagcgccaccattaacccactttgcttgtctcatgaaaaatctttgttaaagtttgtacacaggtaacaaaaagttactttaaaagatatataaagggctgtaagctaattgtggtgtctagtaagtagcataatgagatgtgaggagttggaactttgcgtgttttgcgtattttcatctgcattcagcttcttactctgggtttgtactcgagtgttatttctttacaaatgcccttgtaattaccactctgaagtctgctgactgtgtctcttgaacatacttaggatattctgcacattatggaaaaaggtaaattttagaagtttctgctctactaactgtagatatttatgactctgcgagttatctatttttataaccacctgtggtccattgttcattttaattcacatttcttatgaagtatggtaacagggagggagacacctagattagcagctcaatttgtactacttcagccaatctgtgaatgtaaaaactacactgttgccttgctaggatccaccctcctataatatggaacaaatatctgaatgaaatccaccctaggagacggagtcaaactaaacttgtggtttttcatttaacttttgactacagcatggccccatggcatccacaccaagagggtgttgtgatgaggtgccggtgtgcaaagggaactttagtttttccactggttcttatctgctagccttttacatacatgtgtactatatttgtttatagactgtaggtggatatataatttaaaagcttgatttaataaacatttaaccccctaaacttg

SEQ ID NO: 137927 - DNA, 822 bp, Homo sapiens
  Payload ID: 7012
  Gene Symbol: GPD1L
  Gene Name: glycerol-3-phosphate dehydrogenase 1-like
  ENST ID: ENST00000428684
  CDS Start-End: 101-295
ggggcggggccgccgccagccgctgcgggcaaggctgaacaggcggaggtgggcagccggccagggaagcacggtccaggcggctacattcggcccggccatggcagcggcgcccctgaaagtgtgcatcgtgggctcggggaactggttgccatgtcaaatcttagcgaggctgtgcaggatgcagacctgctggtgtttgtcattccccaccagttcattcacagaatctgtgatgagatcactgggagagtgcccaagaaagcgctgggaatcaccctcatcaagggcatagacgagggccccgaggggctgaagctcatttctgacatcatccgtgagaagatgggtattgacatcagtgtgctgatgggagccaacattgccaatgaggtggctgcagagaagttctgtgagaccaccatcggcagcaaagtaatggagaacggccttctcttcaaagaacttctgcagactccaaattttcgaattaccgtggttgatgatgcagacactgttgaactctgtggtgcgcttaagaacatcgtagctgtgggagctgggttctgcgacggcctccgctgtggagacaacaccaaagcggccgtcatccgcctgggactcatggaaatgattgcttttgccaggatcttctgcaaaggccaagtgtctacagccaccttcctagagagctgcggggtggccgacctgatcaccacctgttacggagggcggaaccgcagggtggccgaggccttcgccagaactgggaagaccattgaagagttggagaaggagatgctgaatgggcaaaagctccaa

SEQ ID NO: 137928 - DNA, 594 bp, Homo sapiens
  Payload ID: 7012
  Gene Symbol: GPD1L
  Gene Name: glycerol-3-phosphate dehydrogenase 1-like
  ENST ID: ENST00000429432
  CDS Start-End: 212-594
atgtatttattttttgttgagacagggtctcactgtccttcagtctggagtgcagtggccctatcctggctcactgaagcctcgacctcctgggcacatgcaattctcccgcctcagcctcctgagtagctaggactataggggttcagctgttgcaaaaataattggtaataatgtcaagaaacttcagaaatttgcctccacagtcaagatgtgggtctttgaagaaacagtgaatggcagaaaactgacagacatcataaataatgaccatgaaaatgtaaaatatcttcctggacacaagctgccagaaaatgtggttgccatgtcaaatcttagcgaggctgtgcaggatgcagacctgctggtgtttgtcattccccaccagttcattcacagaatctgtgatgagatcactgggagagtgcccaagaaagcgctgggaatcaccctcatcaagggcatagacgagggccccgaggggctgaagctcatttctgacatcatccgtgagaagatgggtattgacatcagtgtgctgatgggagccaacattgccaatgaggtggctgcagagaagttctgtgagaccac

SEQ ID NO: 137929 - DNA, 599 bp, Homo sapiens
  Payload ID: 7012
  Gene Symbol: GPD1L
  Gene Name: glycerol-3-phosphate dehydrogenase 1-like
  ENST ID: ENST00000425459
  CDS Start-End: 80-599
gctgcgggcaaggctgaacaggcggaggtgggcagccggccagggaagcacggtccaggcggctacattcggcccggccatggcagcggcgcccctgaaagtgtgcatcgtgggctcggggaactggggttcagctgttgcaaaaataattggtaataatgtcaagaaacttcagaaatttgcctccacagtcaagatgtgggtctttgaagaaacagtgaatggcagaaaactgacagacatcataaataatgaccatgaaaatgtaaaatatcttcctggacacaagctgccagaaaatgtgggcatagacgagggccccgaggggctgaagctcatttctgacatcatccgtgagaagatgggtattgacatcagtgtgctgatgggagccaacattgccaatgaggtggctgcagagaagttctgtgagaccaccatcggcagcaaagtaatggagaacggccttctcttcaaagaacttctgcagactccaaattttcgaattaccgtggttgatgatgcagacactgttgaactctgtggtgcgcttaagaacatcgtagctgtgggagctgggttctgcgacggcctccgct

SEQ ID NO: 137930 - DNA, 621 bp, Homo sapiens
  Payload ID: 7012
  Gene Symbol: GPD1L
  Gene Name: glycerol-3-phosphate dehydrogenase 1-like
  ENST ID: ENST00000431009
  CDS Start-End: 190-621
attcggcccggccatggcagcggcgcccctgaaagtgtgcatcgtgggctcggggaactggtgagcggcggcgggctggaggccggggctccgcttccaggaagcgcctctcccgggcggggttcagctgttgcaaaaataattggtaataatgtcaagaaacttcagaaatttgcctccacagtcaagatgtgggtctttgaagaaacagtgaatggcagaaaactgacagacatcataaataatgaccatgaaaatgtaaaatatcttcctggacacaagctgccagaaaatgtggttgccatgtcaaatcttagcgaggctgtgcaggatgcagacctgctggtgtttgtcattccccaccagttcattcacagaatctgtgatgagatcactgggagagtgcccaagaaagcgctgggaatcaccctcatcaagggcatagacgagggccccgaggggctgaagctcatttctgacatcatccgtgagaagatgggtattgacatcagtgtgctgatgggagccaacattgccaatgaggtggctgcagagaagttctgtgagaccaccatcggcagcaaagtaatggagaacggccttctcttcaaagaacttctg

SEQ ID NO: 137931 - DNA, 6041 bp, Homo sapiens
  Payload ID: 7013
  Gene Symbol: GPD2
  Gene Name: glycerol-3-phosphate dehydrogenase 2 (mitochondrial)
  Uniprot ID: P43304
  ENST ID: ENST00000310454
  CDS Start-End: 373-2556
ttttttttttttgggtggcggggggttgcaagtgggaagcctgctgttcagctgccggggctctccgcctccccccacctgtatgaggctgggtctggggaacctgtgctcagcattccaccccctggagcttgggcttggtcttccctgcgggtccctgcgctgacattcaggcggggagccaggaggcctggcgcgcctccagagcccgccgggggagccgggcgagggttctgggctctgacggcggggtcgcagggtcgcccgcctcctggacacgtctgtaggcctagggaagcctgccggccgggaggtacagagtaggagaagccagatcccagggcggacaacgagaagtcgtcaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcgtgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtgcgtaattacctgagttgtgatgttgaagtgagaagaggggatgtcctggcagcatggagtggaatccgtcctcttgttacagaccccaaatctgcagatactcagtctatctcccgaaatcatgttgttgatatcagtgagagtggccttattactatagcaggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtggcacagcatcttgccgccacctatggtgataaggcctttgaggtggccaaaatggcaagtgtgactggcaaaaggtggcctattgttggagtacgtcttgtgtcagaatttccatatattgaagcagaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaaggtgttggtgtatttgccagctttatttgctgtactttatttgtatttgccattcagtctagcttttaagtatatttttttctttttctcattttcaatgcacattagttttgcatctgttttgtgacctgttagatgtgacacattctctttttgtttattcccttattctaaatgagttctaaaaacataatattttggcaaaaattgaaaaaagctggagacattttgtgacatgcatacagatagcatgtgttattaaaaagagttgcctattgaaatgatcatgtttctggagaaattaagcttatagacagcatgtgttattaaaaagagttacctattgaaatgatagtgtttctggagatttctcagccccatcttcctccagcttgtctaccttcctcatgcaaacaatattccacatttttatatctagagcatgactggctaactggagagggaaggaaaagtttagatctggttactggagcaagtctcaaagagaaactctgaaagcttccagaatcacaggtataagataaggatagcattgacatttgctgggagttacagtgatagtttcatctcagcagttcatttttttcttcagtcactgctggttttctttgactattatagttgccaggaagatccttgctcttcttactttaaaaccagcatttaagtggcaatttggatgtaataggatgagaccaaatttatctaattattacagtagtaatacatttaagagttaaaaatgtgtttttatatatccacatatgataacaaaagattcaattcccaagcctaaattttgaagcatgtggtattgtcaaatctagcttaccatcttttttgggggtacttgcaaccatagtaaaggaagatggaatagactttagttaactttaattataattatatgttaaataaggcacataaccagtttccaaggtcatcatggttgcttaaagtctttccccttctgtactccatggaaatattctcagtaaaccaaaaacaaaaatggaaaaataatcaccaacccccatcccgacacacacacagagtccaaagcaaaagtcagtgtgtattgaatttaacaagtaatgcagtttgggatgcttttgctacattttggtggcattttaactagttatctgaatatttattaatcgtacttcctcttgtaaagttaactacttacttttttgttgttgtttttttaacatcaggttctgtatctaataggagatgtaacactttatttcatggcaggtttttattgcagagacttgaagtcttagttttttaaactggcacataaaacactttttgctgttatttttatttatgtcaatactgcagagtatctttatgccttattcaagtggattctgagcctgtatgtcacaatgtaaacactggaggttcactcacctacgcactcacccaccacctctgaaagaaacagaaactgcagagaaagacagcatcttagctcattttgtttttaaatgaggttttagacgcttgccacttcctaagggaaatcctaaaacagagcaagtgatgctcccaggtatcactgtgaacttttttctttcaaagtgtgaatttttacactggctttttcatttttttaaagtaattgaagcttgtggctttacaacttagtgttttttgctatccagataacaagtttcattgtttagaacccagtgacacttaataggtagataaattgtcctttaaaatatcccagatgatatacacaatatggtacatttgtgctctctctctctgtttttctctctttctctttctagttagatcaagataacgatgacttgtaccctccctgattctgttacagtagggcccgggcagatctgtgtttgttaaacaggccttgtttgtgcatgctttgctatgaatgaagttcctttaaggacaaagaaaagcacacttttcttcttttgagcatatctgcttttactttaaatctgctaatttctaaaatgtagagtccttcaccaatcccagagactcaatttggaaatgaactgatttcaagccgttactgtgaataaagcaccccagcattttgtataagctcttaattaaacctgtacagcttctttacctgatttaagaaagggagacaagcaataggggggaataagcttcttcaaaattcattccaagcacaaaagaaattttttccctttgcatataaacttgacatcagttgattctgttggggtcggggtgggtatgcagggattgccttttattatcaagtgatttatttcaagagcctttgaggggattcaggtgaaggaacccccatctgtgctggagagttggatactcctttaaatagcccccaccacagtcataacaataatgataatgctggattatttgttaagccaaggttgtctgcctcatatccatcatgctgtttgcaatattcttgctttcaatcaatttatactgagtgtaactttaggatttctgctattaaatgcatgctctctatcctgcttcagtttctggctttgctttgtctgtttcaaaatatgtagcttcctcttttgtacaacaaaaaactcattctcacttttactaaatatactgtaggagtcatcattgatgttatttttctcttatgtatctgtaaagatttttggcatatgaatgtaatattaaagtcaatgatgctataacttgcgatgtttgcatcatgtcaacctttttgaaggagtgaaaaagccctactatgtttttaaatagcaagtgtaagctcagtgctagagtggatatacacaccgcatgttttcatatgtggcacttttatgtatcatgttgggttattgttctagactggactgttaaatactatgtttgaggctgggttgtcatttttataactgtcttggtgttttatggccattatttattacttttgatacacagaatgagctgcatgcatttatagagcaataagaggatgtatttaatgtgccttgtttttaactgaataagaactggaagcatgaatcaataaaactgattaaaatggtctatttgctagcattttgatgttacttgcagtcagataactttgattactgttgaagtttaaaaaaagtttgaaaatatttttacaaactgtgtttttgatgacacaaaagtgaaatatctacagagatagatgtaattttataagactgccagaattatttgtattaatttgttgctgtagcctttagggcatgacttctgtatttgtgcaatcctattctacaattacattcatcctattacaactca

SEQ ID NO: 137932 - DNA, 2397 bp, Homo sapiens
  Payload ID: 7013
  Gene Symbol: GPD2
  Gene Name: glycerol-3-phosphate dehydrogenase 2 (mitochondrial)
  Uniprot ID: P43304
  ENST ID: ENST00000409674
  CDS Start-End: 74-2257
agtcacaacactcatatcctagggaccaccacactgctatgagtcaggcatgtgcgttgtttaaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcgtgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtgcgtaattacctgagttgtgatgttgaagtgagaagaggggatgtcctggcagcatggagtggaatccgtcctcttgttacagaccccaaatctgcagatactcagtctatctcccgaaatcatgttgttgatatcagtgagagtggccttattactatagcaggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtggcacagcatcttgccgccacctatggtgataaggcctttgaggtggccaaaatggcaagtgtgactggcaaaaggtggcctattgttggagtacgtcttgtgtcagaatttccatatattgaagcagaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaa

SEQ ID NO: 137933 - DNA, 2661 bp, Homo sapiens
  Payload ID: 7013
  Gene Symbol: GPD2
  Gene Name: glycerol-3-phosphate dehydrogenase 2 (mitochondrial)
  Uniprot ID: P43304
  ENST ID: ENST00000409125
  CDS Start-End: 546-2351
agtcacaacactcatatcctagggaccaccacactgctatgagtcaggcatgtgcgttgtttaaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagagggtcagcggaatcgacttaagaaactgtaaaactttaagaagagaactacgcctgtgagatttactagactgattttgaaaaagactactgataaactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcgtgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtgcgtaattacctgagttgtgatgttgaagtgagaagaggggatgtcctggcagcatggagtggaatccgtcctcttgttacagaccccaaatctgcagatactcagtctatctcccgaaatcatgttgttgatatcagtgagagtggccttattactatagcaggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtggcacagcatcttgccgccacctatggtgataaggcctttgaggtggccaaaatggcaagtgtgactggcaaaaggtggcctattgttggagtacgtcttgtgtcagaatttccatatattgaagcagaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaaggtgttggtgtatttgccagctttatttgctgtactttatttgtatttgccattcagtctagcttttaagtatatttttttctttttctcattttcaatgcacattagttttgcatctgttttgtgacctgttagatgtgacacattctctttttgtttattcccttatt

SEQ ID NO: 137934 - DNA, 2640 bp, Homo sapiens
  Payload ID: 7013
  Gene Symbol: GPD2
  Gene Name: glycerol-3-phosphate dehydrogenase 2 (mitochondrial)
  Uniprot ID: P43304
  ENST ID: ENST00000409861
  CDS Start-End: 74-2257
agtcacaacactcatatcctagggaccaccacactgctatgagtcaggcatgtgcgttgtttaaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcgtgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtgcgtaattacctgagttgtgatgttgaagtgagaagaggggatgtcctggcagcatggagtggaatccgtcctcttgttacagaccccaaatctgcagatactcagtctatctcccgaaatcatgttgttgatatcagtgagagtggccttattactatagcaggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtggcacagcatcttgccgccacctatggtgataaggcctttgaggtggccaaaatggcaagtgtgactggcaaaaggtggcctattgttggagtacgtcttgtgtcagaatttccatatattgaagcagaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattatgagatttaaaatcattttgatgatttctctaagattatgttgagtttctaaaacttggtttgtgttaaatctgttcattgatttggagactgacagatataaaagatgtaaaacttttttacatgttcatagccttctatgaagagtgtggaagaatcacaacaatgaagagaagatatgtttcttggggagcatgttcaatctaattcaagtagatacatggagtcgtgaagataaattctgatcacaccgcattctggtcatcattacctagttgaagaggtttattggagaagaactatcagtgttttaaagcagtggtcttcaaacgggggcacacaaagactttccaaggggggtacataaatataaatagttttaaggt

SEQ ID NO: 137935 - DNA, 537 bp, Homo sapiens
  Payload ID: 7013
  Gene Symbol: GPD2
  Gene Name: glycerol-3-phosphate dehydrogenase 2 (mitochondrial)
  ENST ID: ENST00000416888
  CDS Start-End: 74-244
agtcacaacactcatatcctagggaccaccacactgctatgagtcaggcatgtgcgttgtttaaggctaagaaatggcatttcaaaaggcagtgaaagggacgattcttgttggaggaggtgctcttgcaactgttttaggactttctcagtttgctcattacagaaggaaacaaaatatagttttgtcaggagaactgaggaatgaagaatgtatacttctgagaaagtgtggaaagacatgaagtcctttttcctcctccttcaccactttaatatgtcatctgaatgaattgctagtactggatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagagggtcagcggaatcgacttaagaaactgtaaaactttaagaagagaactacgcctgtgaga

SEQ ID NO: 137936 - DNA, 496 bp, Homo sapiens
  Payload ID: 7013
  Gene Symbol: GPD2
  Gene Name: glycerol-3-phosphate dehydrogenase 2 (mitochondrial)
  ENST ID: ENST00000430992
  CDS Start-End: 54-224
agggaccaccacactgctatgagtcaggcatgtgcgttgtttaaggctaagaaatggcatttcaaaaggcagtgaaagggacgattcttgttggaggaggtgctcttgcaactgttttaggactttctcagtttgctcattacagaaggaaacaaaatatagttttgtcaggagaactgaggaatgaagaatgtatacttctgagaaagtgtggaaagacatgaagtcctttttcctcctccttcaccactttaatatgtcatctgaatgaattgctagtactggatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcat

SEQ ID NO: 137937 - DNA, 2457 bp, Homo sapiens
  Payload ID: 7013
  Gene Symbol: GPD2
  Gene Name: glycerol-3-phosphate dehydrogenase 2 (mitochondrial)
  Uniprot ID: P43304
  ENST ID: ENST00000438166
  CDS Start-End: 134-2317
cccgcgcgcctcgctgggagcacccgggccgaggctctgattctggggggaggccgactccaccctggctggaggaactgggtgctcctgcccgctggcccctcgcgcgtgaggatctatctcaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcgtgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtgcgtaattacctgagttgtgatgttgaagtgagaagaggggatgtcctggcagcatggagtggaatccgtcctcttgttacagaccccaaatctgcagatactcagtctatctcccgaaatcatgttgttgatatcagtgagagtggccttattactatagcaggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtggcacagcatcttgccgccacctatggtgataaggcctttgaggtggccaaaatggcaagtgtgactggcaaaaggtggcctattgttggagtacgtcttgtgtcagaatttccatatattgaagcagaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaa

SEQ ID NO: 137938 - DNA, 456 bp, Homo sapiens
  Payload ID: 7013
  Gene Symbol: GPD2
  Gene Name: glycerol-3-phosphate dehydrogenase 2 (mitochondrial)
  ENST ID: ENST00000415049
  CDS Start-End: 129-456
attagtacagcacccagaggtcttcggagcaaagctgttaaagaagtggggtccatttgagccccaactttgccttccttaggtccccttgggcttgtctagccctaggagttccaacaagctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagca

SEQ ID NO: 137939 - DNA, 1961 bp, Homo sapiens
  Payload ID: 7013
  Gene Symbol: GPD2
  Gene Name: glycerol-3-phosphate dehydrogenase 2 (mitochondrial)
  ENST ID: ENST00000540309
  CDS Start-End: 38-1177
ggcccctcgcgcgtgaggatctatctcaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcgtgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaaggtgttggtgtatttgccagctttatttgctgtactttatttgtatttgccattcagtctagcttttaagtatatttttttctttttctcattttcaatgcacattagttttgcatctgttttgtgacctgttagatgtgacacattctctttttgtttattcccttattctaaatgagttctaaaaacataatattttggcaaaaattgaaaaaagctggagacattttgtgacatgcatacagatagcatgtgttattaaaaagagttgcctattgaaatgatcatgtttctggagaaattaagcttatagacagcatgtgttattaaaaagagttacctattg

SEQ ID NO: 137940 - DNA, 2643 bp, Homo sapiens
  Payload ID: 7014
  Gene Symbol: GNPAT
  Gene Name: glyceronephosphate O-acyltransferase
  Uniprot ID: O15228
  ENST ID: ENST00000366647
  CDS Start-End: 170-2212
ttccgtcctggctgagatggcggcgcccgggatcctgtgtagcggctgcagagggtgccgccgccctaggcgaagtagggccgtcctgagcgaaagaaccgcccccagcaggagcaccaccacggcttagcaaagaatcccagaccccgcccgggaaggcagccgcaccatggagtcttccagttcatctaactcttatttctccgttggcccaaccagtcccagcgctgtcgtgctcctctactcgaaggagctcaaaaagtgggatgagtttgaagatattttagaagagaggaggcatgtcagtgacttgaaatttgcaatgaaatgctacacacctcttgtctataagggaattactccatgtaaaccaattgatattaaatgtagtgttctcaattctgaggagattcattatgtcattaaacagctttccaaggaatcccttcaatctgtggatgtcctccgagaggaagtgagtgagatcttagatgaaatgagtcacaaactgcgtcttggagccattcggttttgtgccttcaccctgagcaaagtatttaaacaaattttctcgaaggtgtgtgtaaatgaagaaggtattcagaaactacaaagagccatccaggagcatcctgttgttctgctgcctagtcatcgaagttacattgacttcctcatgttgtcttttcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagttatgataagatcttggaagaaactctttatgtgtatgagcttctaggggttcctaaaccaaaagagtctacaactgggttgctgaaagccagaaagattctctctgaaaattttggaagcatccatgtgtactttggagatcctgtgtcacttcgatctttggcagctgggaggatgagtcggagctcatataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagtcagaaaattcacaagtcagcttctcgatcaaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcgaaggactcattacaacaaacagggaagtaaaggaagagacacatcctctcatactccctgagactctgagaacagtggacgcagagggaagagatgatcattggaagcaatcagtttactcttccccaccacagtggttaaaaggcgtttgtatctgacactatgtgtgtgttttaaaataaacttttggaaacatgtttggaaaagcaaagctcagctcatttcactaacacttttcagcttactatatgtattaaacttttatgttgacttttgaattaaagtatgacaacactgaaagctctggatattaaaagaaaatgaaaagggcatatctacgttacttgtagcttgctttaattaaagttgcctcaaacaagta

SEQ ID NO: 137941 - DNA, 839 bp, Homo sapiens
  Payload ID: 7014
  Gene Symbol: GNPAT
  Gene Name: glyceronephosphate O-acyltransferase
  ENST ID: ENST00000436239
  CDS Start-End: 173-839
ggcttccgtcctggctgagatggcggcgcccgggatcctgtgtagcggctgcagagggtgccgccgccctaggcgaagtagggccgtcctgagcgaaagaaccgcccccagcaggagcaccaccacggcttagcaaagaatcccagaccccgcccgggaaggcagccgcaccatggagtcttccagttcatctaactcttatttctccgttggcccaaccagtcccagcgctgtcgtgctcctctactcgctttccaaggaatcccttcaatctgtggatgtcctccgagaggaagtgagtgagatcttagatgaaatgagtcacaaactgcgtcttggagccattcggttttgtgccttcaccctgagcaaagtatttaaacaaattttctcgaaggtgtgtgtaaatgaagaaggtattcagaaactacaaagagccatccaggagcatcctgttgttctgctgcctagtcatcgaagttacattgacttcctcatgttgtcttttcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagtt

SEQ ID NO: 137942 - DNA, 1924 bp, Homo sapiens
  Payload ID: 7014
  Gene Symbol: GNPAT
  Gene Name: glyceronephosphate O-acyltransferase
  ENST ID: ENST00000416000
  CDS Start-End: 164-1924
cctggctgagatggcggcgcccgggatcctgtgtagcggctgcagagggtgccgccgccctaggcgaagtagggccgtcctgagcgaaagaaccgcccccagcaggagcaccaccacggcttagcaaagaatcccagaccccgcccgggaaggcagccgcaccatggagtcttccagttcatctaactcttatttctccgttggcccaaccagtcccagcgctgtcgtgctcctctactcgaaggagctcaaaaagtgggatgagtttgaagatattttagaagagaggaggcatgtcagtgacttgaaatttgcaatgaaatgctacacacctcttgtctataagggaattactccatgtaaaccaattgatattaaatgtagtgttctcaattctgaggagattcattatgtcattaaacagctttccaaggaatcccttcaatctgtggatgtcctccgagaggaagtgagtgagatcttagatgaaatgagtcacaaactgcgtcttggagccattcggttttgtgccttcaccctgagcaaagtatttaaacaaattttctcgaagctacaaagagccatccaggagcatcctgttgttctgctgcctagtcatcgaagttacattgacttcctcatgttgtcttttcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagttatgataagatcttggaagaaactctttatgtgtatgagcttctaggggttcctaaaccaaaagagtctacaactgggttgctgaaagccagaaagattctctctgaaaattttggaagcatccatgtgtactttggagatcctgtgtcacttcgatctttggcagctgggaggatgagtcggagctcatataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgag

SEQ ID NO: 137943 - DNA, 5489 bp, Homo sapiens
  Payload ID: 7015
  Gene Symbol: GPCPD1
  Gene Name: glycerophosphocholine phosphodiesterase 1
  Uniprot ID: Q9NPB8
  ENST ID: ENST00000379019
  CDS Start-End: 214-2232
agtttggtctggagcagctgaaaccggtttgagcgtggctgcttcctgccgctcgacgccgcggcaggccgcctggggggagcgctggcgaggcacggacggcgggcgcccggtacctctgcccgcggtcctcgctctcgggcggggcggcggcgacgcggacctgcggactagcgaacccggagcacgacatcataaaataaatccatcagaatgacaccttctcaggttgcctttgaaataagaggaactcttttaccaggagaagtttttgcgatatgtggaagctgtgatgctttgggaaactggaatcctcaaaatgctgtggctcttcttccagagaatgacacaggtgaaagcatgctatggaaagcaaccattgtactcagtagaggagtatcagttcagtatcgctacttcaaagggtactttttagaaccaaagactatcggtggtccatgtcaagtgatagttcacaagtgggagactcatctacaaccacgatcaataacccctttagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccttgtggaaacttcaggaaggatgaatccgtctttgtgctccacggctcgtaccttgatcaggctgtgcatcacagtaattctgttctaggtaggcagagttgatctttgtctcatctgccaggctgcaggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggcaacaatcctagtttcctaactcagattgtttcacgataaa

SEQ ID NO: 137944 - DNA, 4015 bp, Homo sapiens
  Payload ID: 7015
  Gene Symbol: GPCPD1
  Gene Name: glycerophosphocholine phosphodiesterase 1
  ENST ID: ENST00000418646
  CDS Start-End: 1-793
ttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaatctgtggttcaggaggaaaattccttttcagaaaatcagccatttccttctcttaagatgggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccttgtggaaacttcaggaaggatgaatccgtctttgtgctccacggctcgtaccttgatcaggctgtgcatcacagtaattctgttctaggtaggcagagttgatctttgtctcatctgccaggctgcaggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggcaacaa

SEQ ID NO: 137945 - DNA, 571 bp, Homo sapiens
  Payload ID: 7015
  Gene Symbol: GPCPD1
  Gene Name: glycerophosphocholine phosphodiesterase 1
  ENST ID: ENST00000633552
  CDS Start-End: 1-187
agaaaatactattgcttctttaagaaatgctgctagtcatggtgcagcctttgtagaatttgacgtacacctttcaaaggactttgtgcccgtggtatatcatgatcttacctgttgtttgactatgaaaaagctgtcttcagcgctacagctttctgccagctgcattttccttccagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggca

SEQ ID NO: 137946 - DNA, 819 bp, Homo sapiens
  Payload ID: 7015
  Gene Symbol: GPCPD1
  Gene Name: glycerophosphocholine phosphodiesterase 1
  ENST ID: ENST00000481690
  CDS Start-End: 112-417
cgggcgcccggtacctctgcccgcggtcctcgctctcgggcggggcggcggcgacgcggacctgcggactagcgaacccggagcacgacatcataaaataaatccatcagaatgacaccttctcaggttgcctttgaaataagaggaactcttttaccaggagaagtttttgcgatatgtggaagctgtgatgctttgggaaactggaatcctcaaaatgctgtggctcttcttccagagaatgacacaggtgaaagcatgctatggaaagcaaccattgtactcagtagaggagtatcagttcagtatcgctacttcaaagggtactttttagaaccaaagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccacca

SEQ ID NO: 137947 - DNA, 2958 bp, Homo sapiens
  Payload ID: 7016
  Gene Symbol: GDE1
  Gene Name: glycerophosphodiester phosphodiesterase 1
  Uniprot ID: Q9NZC3
  ENST ID: ENST00000353258
  CDS Start-End: 182-1177
gattggctgggcggccgactccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacagtttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacggaatttggggaagccaccatgcaatccagtgaggcttcagtgtacagcaaccaaaatggtagggaggtcttgaagccaatgagggatttatagcatcttgaatagagagctgcaaaccaccagggggcagagttgcatttttccaggctttttaggaagctctgcaacagatgtgatctgatcataggcaattagaactggaagaaacttccaaaaatatctaggtttgtcctcattttacaaatgaggaaactaaactctgtggaagggaaggggttgcctcaaaagtcacagcttagctgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaaaaaaaaaaaaaaaaaaaaaaaaaaaaagataactagaacttctagaacatcttgtttacagttagccagaaactatacaagtggtttaacatgcattatcttactcaatccatacaaaagtcttatggaggtgttagcactctttctactgatgaagaactgaggtacttcataaaaccacttacccaaggtgtcttgagtctggtacaactggcattcaaatctaggtcagtctgcccccagagccactacccttacccctcactgaatctgcctttatattgttgagcccatgaccccaaactgctctttccaatttgaacttccagggattttattgtgaacttacatagcaacattaaaatgaagttgaattgtttttaatggcaacgccgtctgtctcctctagcttaccgcttctcacctttcaaccccatctgtggcctttgtccaggcccacagcttagccatggcttccctcctgcatccctgccgtgggttgctggcctcacacttgcagcagctggacagtgattttagaaggccaccagtccccatagctatgtgacaatgagaagcaaacttttttgtgacagattgtattggcataggcatgatagatggggattggtacgttttgaatcagcatttgcaaaaaaattgtcttgaattttaaaataaacaacaaagatttgttcattgagtgcaacaaa

SEQ ID NO: 137948 - DNA, 739 bp, Homo sapiens
  Payload ID: 7016
  Gene Symbol: GDE1
  Gene Name: glycerophosphodiester phosphodiesterase 1
  ENST ID: ENST00000569773
  CDS Start-End: 432-739
aaggcacactcccggcccttgatcgctcccagtgtctagggatctccggacttgaggttttatatttacagaagacagcagatatgtatatagtttctgtgcgcctgacgctaaggttacatacagccaggaacaaggtcaaaagtgtccctggtttacagagtgtacatcggaatgggggaggcaagccttaaacaagtaaacacataaatgagataactttaagagagtgaaaggtgcaatgaagaaatcgggggaactcgaaggaaagagttacgctattttatttagatggaatagtcaagagaaatcgtctccgaagaagcaacatttgaacagaaaccggaattataaggagccaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaaggt

SEQ ID NO: 137949 - DNA, 1618 bp, Homo sapiens
  Payload ID: 7016
  Gene Symbol: GDE1
  Gene Name: glycerophosphodiester phosphodiesterase 1
  ENST ID: ENST00000569899
  CDS Start-End: 1-390
ggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaaggtaacattcgggatttttcttgtacatattagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccgtaagttggaaggttttttattttacccagacagacatcctgaatgctcttatttgaaaggaaggattaacagagtagacaacctgaattggttctgacctgcaaagcttaccatacctctaaattggattaccaatttcgcttcttaggtgggaagagttcaggcatatttcactgttttcagaccgagtcgatcacatattttcggttttttagtgtattttgaagaaaaaaaatgaacctgtgacactatgctgagcaagggattttatttctgtgactggtttttttgaaagccaacacaggatcctgggcagaaccacagtgaagacatcctgtgggcaccagcctccccactaccgtcttatgttataggcactcccccacctctccccataaaatttccatttcctaacctgctagcgatctcggaatcatttctttggcaattctgtatctgtatatttcagctaattagagttgtaggtctagtattatttcagacatacatgattcagttcaataaatatttggtaagtgcctatactattgcaaggttccatgttgagaagctgaagatgcagtgggtaaagaatcaaagccatgatctctgccctcgtgacgtttatagccaagtgggagagtgagagatgctaatcaaataaaaatccaatcaatataaagttaaaactaagatacaggctatgtcagagaaaactgtgcatgggctataatctaatctggtctgggttgtcagaaacagcatccccaaggaagtgacagttaagctaagatctgaagggtgagtgggaattgggaggaatccagatcagagagaaaaatacatgtaatgtgctctggcaggaaggaacatggttctttccaggaagtgaaagaaaattaatattctttcaattaatttaaaattaatcagcacagaaaagaaagggggaatgtggtgtgagatgaagccaaggagacaggtcggggccaggtcaggcacaccttcagtggctgtgc

SEQ ID NO: 137950 - DNA, 2238 bp, Homo sapiens
  Payload ID: 7016
  Gene Symbol: GDE1
  Gene Name: glycerophosphodiester phosphodiesterase 1
  ENST ID: ENST00000564172
  CDS Start-End: 160-486
ctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacagtttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacggaatttggggaagccaccatgcaatccagtgaggcttcagtgtacagcaaccaaaatggtagggaggtcttgaagccaatgagggatttatagcatcttgaatagagagctgcaaaccaccagggggcagagttgcatttttccaggctttttaggaagctctgcaacagatgtgatctgatcataggcaattagaactggaagaaacttccaaaaatatctaggtttgtcctcattttacaaatgaggaaactaaactctgtggaagggaaggggttgcctcaaaagtcacagcttagctgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaaaaaaaaaaaaaaaaaaaaa

SEQ ID NO: 137951 - DNA, 1821 bp, Homo sapiens
  Payload ID: 7017
  Gene Symbol: GDPD1
  Gene Name: glycerophosphodiester phosphodiesterase domain containing 1
  Uniprot ID: Q8N9F7
  ENST ID: ENST00000284116
  CDS Start-End: 138-1082
ccgacaagtgcgctgcaccagtggcaccggctgggggcgagccgacctcgagcagccgccgccgccgccgtcgttgctactgccgcagcggagttcagagggcccggaggtgggagacttcccacacggtgactgagatgtcgtccactgcggctttttaccttctctctacgctaggaggatacttggtgacctcattcttgttgcttaaatacccgaccttgctgcaccagagaaagaagcagcgattcctcagtaaacacatctctcaccgcggaggtgctggagaaaatttggagaatacaatggcagcctttcagcatgcggttaaaatcggaactgatatgctagaattggactgccatatcacaaaagatgaacaagttgtagtgtcacatgatgagaatctaaagagagcaactggggtcaatgtaaacatctctgatctcaaatactgtgagctcccaccttaccttggcaaactggatgtctcatttcaaagagcatgccagtgtgaaggaaaagataaccgaattccattactgaaggaagtttttgaggcctttcctaacactcccattaacatcgatatcaaagtcaacaacaatgtgctgattaagaaggtttcagagttggtgaagcggtataatcgagaacacttaacagtgtggggtaatgccaattatgaaattgtagaaaagtgctacaaagagaattcagatattcctatactcttcagtctacaacgtgtcctgctcattcttggccttttcttcactggcctcttgccctttgtgcccattcgagaacagttttttgaaatcccaatgccttctattatactgaagctaaaagaaccacacaccatgtccagaagtcaaaagtttctcatctggctttctgatctcttactaatgaggaaagctttgtttgaccacctaactgctcgaggcattcaagtgtatatttgggtattaaatgaagaacaagaatacaaaagagcttttgatttgggagcaactggggtgatgacagactatccaacaaagcttagggattttttacataacttttcagcatagaaaaagaggtacttagaagtattgaaggaaaaaatgaagacctaagaaaaaaatatttcatgatcatttccctaagccatttccagaatggtaaaaggtttaatcagtttttattacctcatttttaagcctgtatgagaatgtagaaactatatattatatgtatatttattttaaataatattgtatattttatgtttgtaaattgtttagaaagataattggttatgagatgtaagttttaatttcttaatgtgcatttttgtttctagatcttatacagaaatcttgattaataacatacacagaaatgtacatactacatcatctacagaaatcttgatcaataacctagaaactaggttatctaggttattgatcaagatttctgtagatgatgcagtgttctatcataagtaattctggaatcaaagactattggatacatttggcattgggctgagtgtggtggctcatgcctgtaatcccagcactttgggaggctgagacaggcggatcatctgaagtcaggagttaaagaccagcctggccaacatggcaaaaccccatctctaccaaaaatacaaaaattaaccatgcgtggtggtacacgtctgtcatcccagcagctcttaaggctgaggcacaagaattgcttgaacccgggaggcagaggctgtagtgagccaagatagcaccactgcactccagcctgggagacagagtgagactccgtctc

SEQ ID NO: 137952 - DNA, 934 bp, Homo sapiens
  Payload ID: 7017
  Gene Symbol: GDPD1
  Gene Name: glycerophosphodiester phosphodiesterase domain containing 1
  ENST ID: ENST00000578026
  CDS Start-End: 144-536
ccggcaccgacaagtgcgctgcaccagtggcaccggctgggggcgagccgacctcgagcagccgccgccgccgccgtcgttgctactgccgcagcggagttcagagggcccggaggtgggagacttcccacacggtgactgagatgtcgtccactgcggctttttaccttctctctacgctaggaggatacttggtgacctcattcttgttgcttaaatacccgaccttgctgcaccagagaaagaagcagcgattcctcagtaaacacatctctcaccgcggaggtgctggagaaaatttggagaatacaatggcagcctttcagcatgcggttaaaatcggaactgatatgctagaattggactgccatatcacaaaagatgaacaagttgtagtgtcacatgatgagaatctaaagagagcaactggggtcaatgtaaacatctctgatctcaaatactgtgagctcccaccttaccttggcaaactggatgtctcatttcaaagaggtttcagagttggtgaagcggtataatcgagaacacttaacagtgtggggtaatgccaattatgaaattgtagaaaagtgctacaaagagaattcagatattcctatactcttcagtctacaacgtgtcctgctcattcttggccttttcttcactggcctcttgccctttgtgcccattcgagaacagttttttgaaatcccaatgccttctattatactgaagctaaaagaaccacacaccatgtccagaagtcaaaagtttctcatctggctttctgatctcttactaatgaggaaagctttgtttgaccacctaactgctcgaggcattcaagtgtatatttgggtattaaatgaagaacaagaatacaaaagagcttttgatttgggagcaactggggtgatgacagactatccaacaa

SEQ ID NO: 137953 - DNA, 1265 bp, Homo sapiens
  Payload ID: 7017
  Gene Symbol: GDPD1
  Gene Name: glycerophosphodiester phosphodiesterase domain containing 1
  Uniprot ID: Q8N9F7
  ENST ID: ENST00000581140
  CDS Start-End: 89-958
gagcagccgccgccgccgccgtcgttgctactgccgcagcggagttcagagggcccggaggtgggagacttcccacacggtgactgagatgtcgtccactgcggctttttaccttctctctacgctaggaggatacttggtgacctcattcttgttgcttaaatacccgaccttgctgcaccagagaaagaagcagcgattcctcagtaaacacatctctcaccgcggaggtgctggagaaaatttggagaatacaatggcagcctttcagcatgcggttaaaatcggaactgatatgctagaattggactgccatatcacaaaagatgaacaagttgtagtgtcacatgatgagaatctaaagagagcaactggggtcaatgtaaacatctctgatctcaaatactgtgagctcccaccttaccttggcaaactggatgtctcatttcaaagagcatgccagtgtgaaggaaaagataaccgaattccattactgaaggaagtttttgaggcctttcctaacactcccattaacatcgatatcaaagtcaacaacaatgtgctgattaagaaggtttcagagttggtgaagcggtataatcgagaacacttaacagtgtggggtaatgccaattatgaaattgtagaaaagtgctacaaagagaattcagatattcctatactcttcagtctacaacgtgtcctgctcattcttggccttttcttcactggcctcttgccctttgtgcccattcgagaacagttttttgaaatcccaatgccttctattatactgaagctaaaagaaccacacaccatgtccagaagtcaaaagtttctcatctggctttctgatctcttactaatgaggaaagctttgtttgaaccactgcacccggccagtaaaagaaattttgaaggccattgcagctatttggtagtgtcttgttatttctaggtgtaccttagttaaagaggaaaaataaaacggaaaaaagcttggaaatcagtgatgtgtagttatttggcaagttatacataatcagcagcagccaggctcaagaaaataaaagttgattagttgatcagaaataaaatctgtagagtgaattagatttctgagttgttgttgttaatggaacattctatttgagacctttttcaggtgtgtagcaattctaccatgtccatttttttaagcattaaaaaggaacttaccagttgtaaattaagacaagatccaaatagtcatatttttgtgtttc

SEQ ID NO: 137954 - DNA, 834 bp, Homo sapiens
  Payload ID: 7017
  Gene Symbol: GDPD1
  Gene Name: glycerophosphodiester phosphodiesterase domain containing 1
  ENST ID: ENST00000579020
  CDS Start-End: 81-713
gccgccgccgccgtcgttgctactgccgcagcggagttcagagggcccggaggtgggagacttcccacacggtgactgagatgtcgtccactgcggctttttaccttctctctacgctaggaggatacttggtgacctcattcttgttgcttaaatacccgaccttgctgcaccagagaaagaagcagcgattcctcagtaaacacatctctcaccgcggaggtgctggagaaaatttggagaatacaatggcagcctttcagcatgcggttaaaatcggaactgatatgctagaattggactgccatatcacaaaagatgaacaagttgtagtgtcacatgatgagaatctaaagagagcaactggggtcaatgtaaacatctctgatctcaaatactgtgagctcccaccttaccttggcaaactggatgtctcatttcaaagagcatgccagtgtgaaggaaaagataaccgaattccattactgaaggaagtttttgaggcctttcctaacactcccattaacatcgatatcaaagtcaacaacaatgtgctgattaagaaggtttcagagttggtgaagcggtataatcgagaacacttaacagtgtggggtaatgccaattatgaaattgtagaaaagtgctacaaagaggctaaaagaaccacacaccatgtccagaagtcaaaagtttctcatctggctttctgatctcttactaatgaggaaagctttgtttgaccacctaactgctcgaggcattcaagtgtatatttgggtattaaatgaagaacaagaatacaaaagagcttttgatttgggagcaactggg

SEQ ID NO: 137955 - DNA, 585 bp, Homo sapiens
  Payload ID: 7017
  Gene Symbol: GDPD1
  Gene Name: glycerophosphodiester phosphodiesterase domain containing 1
  ENST ID: ENST00000579076
  CDS Start-End: 1-366
tcagatattcctatactcttcagtctacaacgtgtcctgctcattcttggccttttcttcactggcctcttgccctttgtgcccattcgagaacagttttttgaaatcccaatgccttctattatactgaagctaaaagaaccacacaccatgtccagaagtcaaaagtttctcatctggctttctgatctcttactaatgaggaaagctttgtttgaccacctaactgctcgaggcattcaagtgtatatttgggtattaaatgaagaacaagaatacaaaagagcttttgatttgggagcaactggggtgatgacagactatccaacaaagcttagggattttttacataacttttcagcatagaaaaagaggtacttagaagtattgaaggaaaaaatgaagacctaagaaaaaaatatttcatgatcatttccctaagccatttccagaatgattacatctctcatttggagtttggcaatgaaactgctatgaagaatgactgtactctcctatctgtccctggatgacataaatatcatttgctttgttgtttaaactgaaataaagttttccaagaac

SEQ ID NO: 137956 - DNA, 1055 bp, Homo sapiens
  Payload ID: 7017
  Gene Symbol: GDPD1
  Gene Name: glycerophosphodiester phosphodiesterase domain containing 1
  Uniprot ID: Q8N9F7
  ENST ID: ENST00000581276
  CDS Start-End: 49-921
ggagttcagagggcccggaggtgggagacttcccacacggtgactgagatgtcgtccactgcggctttttaccttctctctacgctaggaggatacttggtgacctcattcttgttgcttaaatacccgaccttgctgcaccagagaaagaagcagcgattcctcagtaaacacatctctcaccgcggaggtgctggagaaaatttggagaatacaatggcagcctttcagcatgcggttaaaatcggaactgatatgctagaattggactgccatatcacaaaagatgaacaagttgtagtgtcacatgatgagaatctaaagagagcaactggggtcaatgtaaacatctctgatctcaaatactgtgagctcccaccttaccttggcaaactggatgtctcatttcaaagagcatgccagtgtgaaggaaaagataaccgaattccattactgaaggaagtttttgaggcctttcctaacactcccattaacatcgatatcaaagtcaacaacaatgtgctgattaagaaggtttcagagttggtgaagcggtataatcgagaacacttaacagtgtggggtaatgccaattatgaaattgtagaaaagtgctacaaagagaattcagatattcctatactcttcagtctacaacgtgtcctgctcattcttggccttttcttcactggcctcttgccctttgtgcccattcgagaacagttttttgaaatcccaatgccttctattatactgaagctaaaagaaccacacaccatgtccagaagtcaaaagtttctcatctggctttctgatctcttactaatgaggaaagctttgtttgaccacctaactgctcgaggcattcaagtaagtttctggaatgatgcattttggaagcagcatagctcaccagtttaacacaaatataaagggcaagaacttttaactgacttagtttggcccttgactctgatgctgctgctttactgatccacaaatgaggaccttaagctcttccttacacttagcaataaagcattggcatttctgga

SEQ ID NO: 137957 - DNA, 2169 bp, Homo sapiens
  Payload ID: 7018
  Gene Symbol: GDPD2
  Gene Name: glycerophosphodiester phosphodiesterase domain containing 2
  Uniprot ID: Q9HCC8
  ENST ID: ENST00000374382
  CDS Start-End: 252-1871
gcagatttgctctccctcccgcttcctccctcccatcttcccacccgggctgtgcccaggccacagagcagctgcaggccttgggagaggacccacacagcctcctgtaggtggcaacagtgccacctgtttgactcatagggctgaaccgaggactgaaaaagggaggaggcagaccactcggagaggagctgggaagcagtgcagagaggagagcggagcggagctgccgctgagcaaaggccttcaccatggccgagtcccccggctgctgctccgtctgggcccgctgcctccactgcctgtatagctgccactggaggaaatgccccagagagaggatgcaaaccagcaagtgcgactgtatctggtttggcctgctcttcctcaccttcctcctttccctgagctggctgtacatcgggctcgtccttctcaatgacctgcacaacttcaatgaattcctcttccgccgctggggacactggatggactggtccctggcattcctgctggtcatctctctactggtcacatatgcatccttgctattggtcctggccctgctcctgcggctttgtagacagcccctgcatctgcacagcctccacaaggtgctgctgctcctcattatgctgcttgtggcggctggccttgtgggactggacatccaatggcagcaggagtggcatagcttgcgtgtgtcactgcaggccacagccccattccttcatattggagcagccgctggaattgccctcctggcctggcctgtggctgataccttctaccgtatccaccgaagaggtcccaagattctgctactgctcctattttttggagttgtcctggtcatctacttggcccccctatgcatctcctcaccctgcatcatggaacccagagacttaccacccaagcctgggctggtgggacaccgaggggcccccatgctggctcccgagaacaccctgatgtccttgcggaagacagctgaatgcggagctactgtgtttgagactgatgtgatggtcagctccgatggggtccccttcctcatgcatgatgagcacctcagcaggaccacgaatgtagcctctgtattcccaacccgaatcacagcccacagcagtgacttctcctggactgaactgaagagactcaatgctggatcctggttcctagagaggcgacccttctggggggccaaaccgctggcaggccctgatcagaaagaggctgagagtcagacggtaccagcattagaagagctattggaggaagctgcagccctcaacctttccatcatgttcgacttgcgccgacccccacagaaccacacatactatgacacttttgtgatccagacattggagactgtgctgaatgcaagggtgccccaagccatggtcttttggctaccagatgaagatcgggctaatgtccaacgacgggcacctggaatgcgccagatatatggacgtcagggaggcaacagaacggagaggccccagtttcttaacctcccctatcaagatctgccactattggatatcaaggcattgcataaggataatgtctcggtgaacctatttgtagtgaacaagccctggctcttctctctgctttggtgtgcaggggtggattcggtcaccaccaacgactgccagctgctgcagcagatgcgttaccctatctggcttattacccctcaaacctacctaatcatatgggtcattaccaattgtgtttccaccatgctgcttttgtggaccttcctcctccaaagaagatttgttaagaagagagggaaaactggcttagaaacagcagtgctgctgacaaggatcaacaatttcatgatggagtgaatgccctgccctgcttccccacccaagccagtctacattgcccaaacagcaagggttggagagtggcttaagtggaatgcttcaggggtggtgggttgcaagtggggggagctttgccaacaggaggttttgaaccatgagggccctctgcccaggtgatgggcattccctaagctgctatggaatctgctccctttggggttttgacctgagatgtttgggaagagagtgagtaatgagaagtttctcctcaaatgaaactagaacagaggaagtaaaagggagattgctcggataa

SEQ ID NO: 137958 - DNA, 2438 bp, Homo sapiens
  Payload ID: 7018
  Gene Symbol: GDPD2
  Gene Name: glycerophosphodiester phosphodiesterase domain containing 2
  Uniprot ID: Q9HCC8
  ENST ID: ENST00000453994
  CDS Start-End: 362-2134
aaagccccggcagtgactgggaggggaacaggaggagggacagagggatgggaaagcctgcacaaaggaattcctcaccccaagccccctgaccgccagcgagtaaagaagcagatttgctctccctcccgcttcctccctcccatcttcccacccgggctgtgcccaggccacagagcagctgcaggccttgggagaggacccacacagcctcctgtaggtggcaacagtgccacctgtttgactcatagggctgaaccgaggactgaaaaagggaggaggcagaccactcggagaggagctgggaagcagtgcagagaggagagcggagcggagctgccgctgagcaaaggccttcaccatggccgagtcccccggctgctgctccgtctgggcccgctgcctccactgcctgtatagctgccactggaggaaatgccccagagagaggatgcaaaccagcaagtgcgactgtatctggtttggcctgctcttcctcaccttcctcctttccctgagctggctgtacatcgggctcgtccttctcaatgacctgcacaacttcaatgaattcctcttccgccgctggggacactggatggactggtccctggcattcctgctggtcatctctctactggtcacatatgcatccttgctattggtcctggccctgctcctgcggctttgtagacagcccctgcatctgcacagcctccacaaggtgctgctgctcctcattatgctgcttgtggcggctggccttgtgggactggacatccaatggcagcaggagtggcatagcttgcgtgtgtcactgcaggccacagccccattccttcatattggagcagccgctggaattgccctcctggcctggcctgtggctgataccttctaccgtatccaccgaagaggtcccaagattctgctactgctcctattttttggagttgtcctggtcatctacttggcccccctatgcatctcctcaccctgcatcatggaacccagagacttaccacccaagcctgggctggtgggacaccgaggggcccccatgctggctcccgagaacaccctgatgtccttgcggaagacagctgaatgcggagctactgtgtttgagactgatgtgatggtcagctccgatggggtccccttcctcatgcatgatgagcacctcagcaggaccacgaatgtagcctctgtattcccaacccgaatcacagcccacagcagtgacttctcctggactgaactgaagagactcaatgctggatcctggttcctagagaggcgacccttctggggggccaaaccgctggcaggccctgatcagaaagaggctgagagtcagacggtaccagcattagaagagctattggaggaagctgcagccctcaacctttccatcatgttcgacttgcgccgacccccacagaaccacacatactatgacacttttgtgatccagacattggagactgtgctgaatgcaagggtgccccaagccatggtcttttggctaccagatgaagatcgggctaatgtccaacgacgggcacctggaatgcgccagatatatggacgtcagggaggcaacagaacggagaggccccagtttcttaacctcccctatcaagatctgccactattggatatcaaagacaggttcctactacctgcccaggctggtctcaaactactggcctcaagcaatcttcctgcctcggcctcccaaagtgctgggattacaggcctgagccactgcccccctcagcctcccggttataagcatgagctatctcacctagctatggcattgcataaggataatgtctcggtgaacctatttgtagtgaacaagccctggctcttctctctgctttggtgtgcaggggtggattcggtcaccaccaacgactgccagctgctgcagcagatgcgttaccctatctggcttattacccctcaaacctacctaatcatatgggtcattaccaattgtgtttccaccatgctgcttttgtggaccttcctcctccaaagaagatttgttaagaagagagggaaaactggcttagaaacagcagtgctgctgacaaggatcaacaatttcatgatggagtgaatgccctgccctgcttccccacccaagccagtctacattgcccaaacagcaagggttggagagtggcttaagtggaatgcttcaggggtggtgggttgcaagtggggggagctttgccaacaggaggttttgaaccatgagggccctctgcccaggtgatgggcattccctaagctgctatggaatctgctccctttggggttttgacctgagatgtttgggaagagagtgagtaatgagaagtttctcctcaaatgaaactagaacagaggaagtaaaagggagattgctcggataatgtctc

SEQ ID NO: 137959 - DNA, 2067 bp, Homo sapiens
  Payload ID: 7018
  Gene Symbol: GDPD2
  Gene Name: glycerophosphodiester phosphodiesterase domain containing 2
  Uniprot ID: Q9HCC8
  ENST ID: ENST00000538649
  CDS Start-End: 381-1763
aaagccccggcagtgactgggaggggaacaggaggagggacagagggatgggaaagcctgcacaaaggaattcctcaccccaagccccctgaccgccagcgagtaaagaagcagatttgctctccctcccgcttcctccctcccatcttcccacccgggctgtgcccaggccacagagcagctgcaggccttgggagaggacccacacagcctcctgtaggtggcaacagtgccacctgtttgactcatagggctgaaccgaggactgaaaaagggaggaggcagaccactcggagaggagctgggaagcagtgcagagaggagagcggagcggagctgccgctgagcaaagattcctcttccgccgctggggacactggatggactggtccctggcattcctgctggtcatctctctactggtcacatatgcatccttgctattggtcctggccctgctcctgcggctttgtagacagcccctgcatctgcacagcctccacaaggtgctgctgctcctcattatgctgcttgtggcggctggccttgtgggactggacatccaatggcagcaggagtggcatagcttgcgtgtgtcactgcaggccacagccccattccttcatattggagcagccgctggaattgccctcctggcctggcctgtggctgataccttctaccgtatccaccgaagaggtcccaagattctgctactgctcctattttttggagttgtcctggtcatctacttggcccccctatgcatctcctcaccctgcatcatggaacccagagacttaccacccaagcctgggctggtgggacaccgaggggcccccatgctggctcccgagaacaccctgatgtccttgcggaagacagctgaatgcggagctactgtgtttgagactgatgtgatggtcagctccgatggggtccccttcctcatgcatgatgagcacctcagcaggaccacgaatgtagcctctgtattcccaacccgaatcacagcccacagcagtgacttctcctggactgaactgaagagactcaatgctggatcctggttcctagagaggcgacccttctggggggccaaaccgctggcaggccctgatcagaaagaggctgagagtcagacggtaccagcattagaagagctattggaggaagctgcagccctcaacctttccatcatgttcgacttgcgccgacccccacagaaccacacatactatgacacttttgtgatccagacattggagactgtgctgaatgcaagggtgccccaagccatggtcttttggctaccagatgaagatcgggctaatgtccaacgacgggcacctggaatgcgccagatatatggacgtcagggaggcaacagaacggagaggccccagtttcttaacctcccctatcaagatctgccactattggatatcaaggcattgcataaggataatgtctcggtgaacctatttgtagtgaacaagccctggctcttctctctgctttggtgtgcaggggtggattcggtcaccaccaacgactgccagctgctgcagcagatgcgttaccctatctggcttattacccctcaaacctacctaatcatatgggtcattaccaattgtgtttccaccatgctgcttttgtggaccttcctcctccaaagaagatttgttaagaagagagggaaaactggcttagaaacagcagtgctgctgacaaggatcaacaatttcatgatggagtgaatgccctgccctgcttccccacccaagccagtctacattgcccaaacagcaagggttggagagtggcttaagtggaatgcttcaggggtggtgggttgcaagtggggggagctttgccaacaggaggttttgaaccatgagggccctctgcccaggtgatgggcattccctaagctgctatggaatctgctccctttggggttttgacctgagatgtttgggaagagagtgagtaatgagaagtttctcctcaaatgaaactagaacagaggaagtaaaagggagattgctcggataatgtctc

SEQ ID NO: 137960 - DNA, 2171 bp, Homo sapiens
  Payload ID: 7018
  Gene Symbol: GDPD2
  Gene Name: glycerophosphodiester phosphodiesterase domain containing 2
  Uniprot ID: Q9HCC8
  ENST ID: ENST00000536730
  CDS Start-End: 485-1867
aaagccccggcagtgactgggaggggaacaggaggagggacagagggatgggaaagcctgcacaaaggaattcctcaccccaagccccctgaccgccagcgagtaaagaagcagatttgctctccctcccgcttcctccctcccatcttcccacccgggctgtgcccaggccacagagcagctgcaggccttgggagaggacccacacagcctcctgtaggtggcaacagtgccacctgtttgactcatagggctgaaccgaggactgaaaaagggaggaggcagaccactcggagaggagctgggaagcagtgcagagaggagagcggagcggagctgccgctgagcaaagtgcgactgtatctggtttggcctgctcttcctcaccttcctcctttccctgagctggctgtacatcgggctcgtccttctcaatgacctgcacaacttcaatgaattcctcttccgccgctggggacactggatggactggtccctggcattcctgctggtcatctctctactggtcacatatgcatccttgctattggtcctggccctgctcctgcggctttgtagacagcccctgcatctgcacagcctccacaaggtgctgctgctcctcattatgctgcttgtggcggctggccttgtgggactggacatccaatggcagcaggagtggcatagcttgcgtgtgtcactgcaggccacagccccattccttcatattggagcagccgctggaattgccctcctggcctggcctgtggctgataccttctaccgtatccaccgaagaggtcccaagattctgctactgctcctattttttggagttgtcctggtcatctacttggcccccctatgcatctcctcaccctgcatcatggaacccagagacttaccacccaagcctgggctggtgggacaccgaggggcccccatgctggctcccgagaacaccctgatgtccttgcggaagacagctgaatgcggagctactgtgtttgagactgatgtgatggtcagctccgatggggtccccttcctcatgcatgatgagcacctcagcaggaccacgaatgtagcctctgtattcccaacccgaatcacagcccacagcagtgacttctcctggactgaactgaagagactcaatgctggatcctggttcctagagaggcgacccttctggggggccaaaccgctggcaggccctgatcagaaagaggctgagagtcagacggtaccagcattagaagagctattggaggaagctgcagccctcaacctttccatcatgttcgacttgcgccgacccccacagaaccacacatactatgacacttttgtgatccagacattggagactgtgctgaatgcaagggtgccccaagccatggtcttttggctaccagatgaagatcgggctaatgtccaacgacgggcacctggaatgcgccagatatatggacgtcagggaggcaacagaacggagaggccccagtttcttaacctcccctatcaagatctgccactattggatatcaaggcattgcataaggataatgtctcggtgaacctatttgtagtgaacaagccctggctcttctctctgctttggtgtgcaggggtggattcggtcaccaccaacgactgccagctgctgcagcagatgcgttaccctatctggcttattacccctcaaacctacctaatcatatgggtcattaccaattgtgtttccaccatgctgcttttgtggaccttcctcctccaaagaagatttgttaagaagagagggaaaactggcttagaaacagcagtgctgctgacaaggatcaacaatttcatgatggagtgaatgccctgccctgcttccccacccaagccagtctacattgcccaaacagcaagggttggagagtggcttaagtggaatgcttcaggggtggtgggttgcaagtggggggagctttgccaacaggaggttttgaaccatgagggccctctgcccaggtgatgggcattccctaagctgctatggaatctgctccctttggggttttgacctgagatgtttgggaagagagtgagtaatgagaagtttctcctcaaatgaaactagaacagaggaagtaaaagggagattgctcggataatgtctc

SEQ ID NO: 137961 - DNA, 1397 bp, Homo sapiens
  Payload ID: 7019
  Gene Symbol: GDPD3
  Gene Name: glycerophosphodiester phosphodiesterase domain containing 3
  Uniprot ID: Q7L5L3
  ENST ID: ENST00000406256
  CDS Start-End: 379-1335
cctacacacccctggatcctctgaaatggcaaggggtaggcatgttggatgcgctggctacaagtaccagtgagagggagaggtcctgacagtcctgggtggtttttactcccctcatgtagcccaggacggggctgctgggggctgggaagggcctggggatatgagagccagggctacttgcctcacctcctgacactaccccagcttcagccgaaccctgcagcctggctccaagccagcccagcggcaggctcagcaggtcccaggggcgtggcagtggccagtagtagagccggcccacactggctaggcaggcagcacagtcccgcggacggctgagcgtgtggctgcaggagcttctgtgggagtacggtcatgagccttttgctgtactatgccctccctgccctgggcagctatgccatgctctccatcttcttcctgcgccggcctcatctgctgcacacgcccagggctcccaccttccgcatccgcctgggggcccaccgaggaggatctggagagctgctggagaacaccatggaggccatggagaactccatggcccagcgctcggacctcctggagctcgactgtcagctgacacgggacagagtggtggtggtgtcacatgatgagaacctgtgccgccagtcgggcctaaacagggatgtgggcagcctggacttcgaggacctgcccctctacaaggagaagctggaggtttacttctctccaggccactttgctcacgggtcagaccggcgcatggttcgtctggaggacctgttccagaggtttccaaggacacccatgagcgtagagatcaaagggaagaacgaagagctcatccgtgagatagcaggcttggtgagacgctatgaccgtaatgaaatcaccatctgggcctcggagaagagctcggtcatgaagaaatgcaaggctgccaaccccgagatgcccctgtccttcacaataagccgaggattctgggtgctgctttcctactacctggggctgctgcccttcatcccaatccctgagaagttcttcttctgcttcctgcccaacatcatcaacaggacctatttcccattttcctgctcttgcctgaaccagttattggctgtggtttcgaaatggctgatcatgaggaagagtctgatccgacacttggaggagcgaggggtgcaggtggtcttttggtgccttaatgaagagtcggattttgaagcagccttcagcgtgggagccactggcgtcataacggattatcccacagccctgcggcactacctggacaaccatggaccagctgcccggacctcctaagtccagaagcctcgaggtctcctgtttctcttcctgaaaaataaatatttgcctttcgatca

SEQ ID NO: 137962 - DNA, 235 bp, Homo sapiens
  Payload ID: 7019
  Gene Symbol: GDPD3
  Gene Name: glycerophosphodiester phosphodiesterase domain containing 3
  ENST ID: ENST00000566613
  CDS Start-End: 1-142
catcaacaggacctatttcccattttcctgctcttgcctgaaccagttattggctgtggtttcgaaatggtggtcttttggtgccttaatgaagagtcggattttgaagcagccttcagcgtgggagccactggcgtcataacggattatcccacagccctgcggcactacctggacaaccatggaccagctgcccggacctcctaagtccagaagcctcgaggtctcctgtttc

SEQ ID NO: 137963 - DNA, 399 bp, Homo sapiens
  Payload ID: 7019
  Gene Symbol: GDPD3
  Gene Name: glycerophosphodiester phosphodiesterase domain containing 3
  ENST ID: ENST00000566434
  CDS Start-End: 1-124
gacctatttcccattttcctgctcttgcctgaaccagttattggctgtggtttcgaaatggctgatcatgaggaagagtctgatccgacacttggaggagcgaggggtgcaggtgaggccgtgaccaccacttccaccgcacacagacctggcagcagggttccggtcccactctgctgccaactagctgcatcactcgggcaggtggtcttttggtgccttaatgaagagtcggattttgaagcagccttcagcgtgggagccactggcgtcataacggattatcccacagccctgcggcactacctggacaaccatggaccagctgcccggacctcctaagtccagaagcctcgaggtctcctgtttctcttcctgaaaaataaatatttgcctttc

SEQ ID NO: 137964 - DNA, 2533 bp, Homo sapiens
  Payload ID: 7020
  Gene Symbol: GDPD4
  Gene Name: glycerophosphodiester phosphodiesterase domain containing 4
  Uniprot ID: Q6W3E5
  ENST ID: ENST00000315938
  CDS Start-End: 252-1814
aaagggtgaatcatgtttaagaaggtcaacaggattgagcacaagaggaataagacagaaaaaccaaaaaagcttaatccatggattccacgcatcttcaaccacaaatgctttgtcaccttccttactggctgctatagttgcctctggaaattcagacaatgggaaaaaactaaagttggattttgttgctgcacttggaaagagcaattattttgccgtgcctggtaatttcatttgtcttgtctctgatgttgctgttcctgtggatagaaacatccagtgaatactttaactttgactgggtcacttttctaggaacaggatactggtttttctggtctatttttattctgagtttagctaggatcctgactgcctactcttcattgctgttgttacttggatttttgttgctttgggaaaggattgaactatacctgcacttgtgtcataagatcctgattctgctagtgattcttctgtgtgtcattttaatgttcattatatgcaaattctggaaagaaaggtggctggtagctgggctgtcaatgcagatctttgctccctacgtgcacctggtcagcataactgtgatggttatccttttctggcctgtggccttctacgtggcatgtttggaaagagaagttagaatgagaagatacaggatgacacattctgagaaaaaaagactcaagcaatgtaatgtaatcacaaggttaagaggtctacaagtgcctgttggattaccctttcttcttatccttttaggtctctatttgatgccactggggatttattctccctgcattcaggagaaggagaatttggggcccaagccaaccatctttggacatagaggtgcacccatgttggggcctgagaataccatgatgtcctttgagaaagctgttgaacatggagcccatggattggagactgatatacacttaagttatgatcatgtgcctttcctcatgcatgactttgacctgaaaagaacaaccaatattggggaagttcagccagaatctgcctgcgagaaccctgccttcttcaactgggatttcctatcgactctgaatgcaggcaaatggtttgtaaaaccagagctcaggccattttacaatatgaaacctctatcagaggcagataaagaaagagcaagaaatcagtcaattccaacactagctgatttattgacacttgcagagaaggaaagaaaatttgtgatatttgatcttcatcgccctccaccaaaacatcctctcagacacacatttgtccgccaagtagtaagcgtgatccttgcctctaaaatcgagcaacatctgattttttggttgccagctcatgataggcaatacgtcaggtccgtggctcctggttttcagcatgtgggccgtttagtatccattgaaacccttgctaaaaacaatatcagtataataaatgttgactacaagaagttgttccctaatgggttaagagattataaagcagctaacatccatatcaacgtatacaccgtcaatgagccttggcttttctcactggcctggtgctccaggattaactcagtgaccacagacaacattgggctcctgagtcagcttgatcaccctcacttcttcatgacaccaaagttctatgtgttcatgtggctccttgcagatatcatttctgtgctttttattgttgccatattttgttttcactggcggagagagactgaaaaagaaaaattgtttgaaacctccagcactcgcacagatactcagagtggaagtaagaatgaggaagatagatagatagatagatttgcacatagccatgaaacctcctgtccgagttgtggaaggtccttggactctagcagccctctacccggctctacccaagagtggaaaggaacaccaaggccatttcaattttgcagcaccatccaagaaactactacctatcaagaatgctgtcacacctttgaagcctggcaagcatgagattcaaccaccgatgcccaccgtggtctttgaactcacccaagcacccaccaggcaggctacaagtgaggctacctttcaaactacattgcccaccctgaaggtggataagccaaccatgccctccatagaggtcccctatccttaaataagagacctctaagagatccccatggctgaatactccaaataatcctatgtcacaatatattccattgcatctgacatagccttctgtgtttccaaagaagaattagccacatctcccctgcttcttcctctctctgcctaagggtggtgatggtggggagtggttgataaaggcacacagaagggccacggaggctctcaggggaaccattgtgctctcgctatcaagaatgcatctcaaggggctaggcaaggggaaaactgctgtgtgtggtcttggaactggttgctgtcaggtttatctcatcctaacacctccataatattttctgctaaaggagtgactgtgcatataagtaaaggcaacctctcaggaa

SEQ ID NO: 137965 - DNA, 2502 bp, Homo sapiens
  Payload ID: 7020
  Gene Symbol: GDPD4
  Gene Name: glycerophosphodiester phosphodiesterase domain containing 4
  Uniprot ID: Q6W3E5
  ENST ID: ENST00000376217
  CDS Start-End: 252-2123
aaagggtgaatcatgtttaagaaggtcaacaggattgagcacaagaggaataagacagaaaaaccaaaaaagcttaatccatggattccacgcatcttcaaccacaaatgctttgtcaccttccttactggctgctatagttgcctctggaaattcagacaatgggaaaaaactaaagttggattttgttgctgcacttggaaagagcaattattttgccgtgcctggtaatttcatttgtcttgtctctgatgttgctgttcctgtggatagaaacatccagtgaatactttaactttgactgggtcacttttctaggaacaggatactggtttttctggtctatttttattctgagtttagctaggatcctgactgcctactcttcattgctgttgttacttggatttttgttgctttgggaaaggattgaactatacctgcacttgtgtcataagatcctgattctgctagtgattcttctgtgtgtcattttaatgttcattatatgcaaattctggaaagaaaggtggctggtagctgggctgtcaatgcagatctttgctccctacgtgcacctggtcagcataactgtgatggttatccttttctggcctgtggccttctacgtggcatgtttggaaagagaagttagaatgagaagatacaggatgacacattctgagaaaaaaagactcaagcaatgtaatgtaatcacaaggttaagaggtctacaagtgcctgttggattaccctttcttcttatccttttaggtctctatttgatgccactggggatttattctccctgcattcaggagaaggagaatttggggcccaagccaaccatctttggacatagaggtgcacccatgttggggcctgagaataccatgatgtcctttgagaaagctgttgaacatggagcccatggattggagactgatatacacttaagttatgatcatgtgcctttcctcatgcatgactttgacctgaaaagaacaaccaatattggggaagttcagccagaatctgcctgcgagaaccctgccttcttcaactgggatttcctatcgactctgaatgcaggcaaatggtttgtaaaaccagagctcaggccattttacaatatgaaacctctatcagaggcagataaagaaagagcaagaaatcagtcaattccaacactagctgatttattgacacttgcagagaaggaaagaaaatttgtgatatttgatcttcatcgccctccaccaaaacatcctctcagacacacatttgtccgccaagtagtaagcgtgatccttgcctctaaaatcgagcaacatctgattttttggttgccagctcatgataggcaatacgtcaggtccgtggctcctggttttcagcatgtgggccgtttagtatccattgaaacccttgctaaaaacaatatcagtataataaatgttgactacaagaagttgttccctaatgggttaagagattataaagcagctaacatccatatcaacgtatacaccgtcaatgagccttggcttttctcactggcctggtgctccaggattaactcagtgaccacagacaacattgggctcctgagtcagcttgatcaccctcacttcttcatgacaccaaagttctatgtgttcatgtggctccttgcagatatcatttctgtgctttttattgttgccatattttgttttcactggcggagagagactgaaaaagaaaaattgtttgaaacctccagcactcgcacagatactcagagtggaaatttgcacatagccatgaaacctcctgtccgagttgtggaaggtccttggactctagcagccctctacccggctctacccaagagtggaaaggaacaccaaggccatttcaattttgcagcaccatccaagaaactactacctatcaagaatgctgtcacacctttgaagcctggcaagcatgagattcaaccaccgatgcccaccgtggtctttgaactcacccaagcacccaccaggcaggctacaagtgaggctacctttcaaactacattgcccaccctgaaggtggataagccaaccatgccctccatagaggtcccctatccttaaataagagacctctaagagatccccatggctgaatactccaaataatcctatgtcacaatatattccattgcatctgacatagccttctgtgtttccaaagaagaattagccacatctcccctgcttcttcctctctctgcctaagggtggtgatggtggggagtggttgataaaggcacacagaagggccacggaggctctcaggggaaccattgtgctctcgctatcaagaatgcatctcaaggggctaggcaaggggaaaactgctgtgtgtggtcttggaactggttgctgtcaggtttatctcatcctaacacctccataatattttctgctaaaggagtgactgtgcatataagtaaaggcaacctctcaggaa

SEQ ID NO: 137966 - DNA, 3523 bp, Homo sapiens
  Payload ID: 7021
  Gene Symbol: GDPD5
  Gene Name: glycerophosphodiester phosphodiesterase domain containing 5
  Uniprot ID: Q8WTR4
  ENST ID: ENST00000336898
  CDS Start-End: 839-2656
cggggatgacagcggaggtggcagcggcgcggcgctgagcgagcggcgagggagcaggggaagaggaggaagtggagccgcggccgggagctcgggagtcggccgccgcgccgaggttcgccccgttttgcagagagagccgagtcgggacctggaaagacttccccgcggggctccggccgccgcgcctccccgccggcgcctgccctgccctgcccgtcccagccccgcggttcggggcgtgcggccgggacgcgcggagccccggccctgacccgctgcgccgggacgggacgctcctaacgccgccgtaccggtccgtggttgcagggtcgctccgcgcctttccgtcagtgagggtcggaaccccagctccagggctagcgcagtgtggccccaggccctcgcctccggtgcacgggaccccggacccccccagcctctggcttcacgagaccccaaccttcagttggaacagcttggaacagcgcgagcgcccgggaagccctggccgggtcgtgcgctcggtgaggggtcctaggcgggcaggacagtcggaccgaaccgccgggctggtgccgcgagcccaggctgtcaccttcgtcccgcctcaggtgaggggttcagcgcctgccccgaagataacacaggggtccccttctgtcccggcggcctgcgagagccaaggctgcagctctcccagtgaagtgatatcactgcctctgtggacaagacacctccaggagcccagctcacagccaccggtaccttcttccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactggtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaagatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttga

SEQ ID NO: 137967 - DNA, 3106 bp, Homo sapiens
  Payload ID: 7021
  Gene Symbol: GDPD5
  Gene Name: glycerophosphodiester phosphodiesterase domain containing 5
  ENST ID: ENST00000443276
  CDS Start-End: 117-524
tggtgcctgactcctcacccttcccctgcctcactgccctgtgcttcctcctgcaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactggtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaaggcctcctctgggcttccactatcccctctgtgagggagtttcttctcctggctgcaaagctggcatttgaaagaactgcaccagctggcaccccgggtggggctggcacatgctgtggtcaccttctggggccatgcctggctctcagcaggctgccctgagcacactgcactgctcttctgtcctcgcctgactcccctgcctcagtggcagcagcccccagcccaggacctgcacagaggaggcgtctgtcagcgacccaacctgagccccagagaggagcactgggtaccacacagccccaagatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttg

SEQ ID NO: 137968 - DNA, 3222 bp, Homo sapiens
  Payload ID: 7021
  Gene Symbol: GDPD5
  Gene Name: glycerophosphodiester phosphodiesterase domain containing 5
  Uniprot ID: Q8WTR4
  ENST ID: ENST00000529721
  CDS Start-End: 538-2355
ggctgctttagaagaacaagctggtttggcagctacctcagagaagcaggaccctgggcagcgtgaaagggcctctgcccccagggtggctgggctttggatcctggatccgtgggtcctggaggggcaggagtggttcaggaaacagctctcccagtgaagtgatatcactgcctctgtggacaagacacctccaggagcccagctcacagccaccggtaccttcttccagggctgctgttatagtttctgcatggaaagcacttggaacaatgcctggctgttcccctctttggccctctcagggccctaggagcctttgtgtgtcctgctcacattgtctccagggcctcggacagggcctggtacagaacatatgactgagtttctggagtcccacaggccagcgttggagtcctgacacctcagtatagctgtgcacctctgggcaaatagtttctctgctctgagccccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactggtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaagatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttga

SEQ ID NO: 137969 - DNA, 825 bp, Homo sapiens
  Payload ID: 7021
  Gene Symbol: GDPD5
  Gene Name: glycerophosphodiester phosphodiesterase domain containing 5
  ENST ID: ENST00000532435
  CDS Start-End: 605-825
ttggaacagcgcgagcgcccgggaagccctggccgggtcgtgcgctcggtgaggggtcctaggcgggcaggacagtcggaccgaaccgccgggctggtgccgcgagcccaggctgtcaccttcgtcccgcctcaggtgaggggttcagcgcctgccccgaagataacacaggggtccccttctgtcccggcggcctgcgagagccaaggctgcagctctcccagtgaagtgatatcactgcctctgtggacaagacacctccaggagcccagctcacagccaccggtaccttcttccagggctgctgttatagtttctgcatggaaagcacttggaacaatgcctggctgttcccctctttggccctctcagggccctaggagcctttgtgtgtcctgctcacattgtctccagggcctcggacagggcctggtacagaacatatgactgagtttctggagtcccacaggccagcgttggagtcctgacacctcagtatagctgtgcacctctgggcaaatagtttctctgctctgagccccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactg

SEQ ID NO: 137970 - DNA, 4150 bp, Homo sapiens
  Payload ID: 7021
  Gene Symbol: GDPD5
  Gene Name: glycerophosphodiester phosphodiesterase domain containing 5
  Uniprot ID: Q8WTR4
  ENST ID: ENST00000526177
  CDS Start-End: 1880-3283
tcacagctctggaaaggtccctggagaggatgtggaaagatccccagtaggtagcagagccaggattcgactgaagaccgtgattcaagtgaggctcttaaccctgggccagctgtctgccatttggactgcaaaacccagaggccagatacccctaagaggccagctgttgcacctctgcaaggcggggttccacctcctctcgggtcccggcacctaggccagactcatcgaatgaatgaaagactctgttgtatcccctgtacccaccatggctatcacaagccacagtcccatgaagacagagaacccaaggccactttctcagaggaggacggtgatctgtctctgggcctctagggtgggattcatccttctcagtcagatttcaggagcgatggtggttgcgtttttgggtgtcagtgctattgctataacttaatgatgcaaggtagggaagtcccacagacactgaacatgcagtgatgctgctgagtgtgttgattagcaccaaagcaactgtggaactcagagataataacatttttaattgtattagggtttggggaatcagttttattgcaagtcgtttccattaataggtattgtgatgagatgctcctggaaaccatccttaactcactgtgtgcagggccacctcccacgatggccacaagggggagctgcgcgccgggggcagccgggagaaggggcctgagtgccgagggcggggttctcaggggttcggaggcgcagctgggcctcccagagactgcgcagcctctctgacaccagcgtgctgtctgtccgagaaagcgcacacccccttaccccctgagatgggcagaaggtgttcgtttctggttctgccccttcaaagctccgtgacccagccagctgttcctctccccgaacctcgcttcccgtgtgtgagatgaggatgctcgtgcctccgcggaaccaacctggggaccacgcgaagcgcccccacaggcccaggctgatgggctggaatgaaaagcctccaaagggaaacttcatcccaggcgagactcagcattccccgccggcgagtgaaggtccctgggtagggagcggagatgctggccaccgccccaccctcatcgtctagaaatgccactgtccctgctcggcatcagagggccctggccgctgctgcctctgggaaaggttgcctcgggagaaagggggtgaaggccctgccagcagctagaacggctccagggaggcagggcggccggcagtgctgtgggagaaggacaggcctttggagggagatgggagacgagtctggagaaactagggggacggaggtggcggctttgactgacccttccagagactgggatctgcgggaggctttggaggagagccacaacctgggcttcggggaggcacgcctgggggtgtggaggggggtgggtggagtgagatccacggctaggggcgaggggctgggggccgaggagccgaaaacctctgccgagcttcacgtggttaaagatttcaggtcttacctgtcaccagagatctctgtcccgtagaggtgccacctcatcctccatgagagctgtgctttgctttcttctggaggctgcaaggaggatggcccccatcacggcggacctagatgctgggagtccgggagagggcaggccgtggagatggggcaggtggcgatgtgtttcaccacccactcccgcctgaagtgccactgtgagcccagcccagggtgccaggctgggctgcactccaggctcctgcagcagacccagttcctcagcctccttcccctgaggcctgggcatggcctggacaaatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttga

SEQ ID NO: 137971 - DNA, 2424 bp, Homo sapiens
  Payload ID: 7021
  Gene Symbol: GDPD5
  Gene Name: glycerophosphodiester phosphodiesterase domain containing 5
  Uniprot ID: Q8WTR4
  ENST ID: ENST00000533805
  CDS Start-End: 476-1558
cggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatggcatcaggagaaccctccaggagagctgggaggcagctcagagcccactgtgacagtgagtacggctgaaccgacgtgagttggagaaagacgaagggatcaaagtcagcgccgcattctgccaccagtgcactccatagccctgcaggagagcttcgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttg

SEQ ID NO: 137972 - DNA, 527 bp, Homo sapiens
  Payload ID: 7021
  Gene Symbol: GDPD5
  Gene Name: glycerophosphodiester phosphodiesterase domain containing 5
  ENST ID: ENST00000534322
  CDS Start-End: 1-527
gcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaactatcacttgatcaggtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgt

SEQ ID NO: 137973 - DNA, 2441 bp, Homo sapiens
  Payload ID: 7021
  Gene Symbol: GDPD5
  Gene Name: glycerophosphodiester phosphodiesterase domain containing 5
  Uniprot ID: Q8WTR4
  ENST ID: ENST00000533784
  CDS Start-End: 114-1574
tggacaagacacctccaggagcccagctcacagccaccggtaccttcttccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttga

SEQ ID NO: 137974 - DNA, 3211 bp, Homo sapiens
  Payload ID: 7021
  Gene Symbol: GDPD5
  Gene Name: glycerophosphodiester phosphodiesterase domain containing 5
  ENST ID: ENST00000527820
  CDS Start-End: 221-628
ctttgtgtgtcctgctcacattgtctccagggcctcggacagggcctggtacagaacatatgactgagtttctggagtcccacaggccagcgttggagtcctgacacctcagtatagctgtgcacctctgggcaaatagtttctctgctctgagccccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactggtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaaggcctcctctgggcttccactatcccctctgtgagggagtttcttctcctggctgcaaagctggcatttgaaagaactgcaccagctggcaccccgggtggggctggcacatgctgtggtcaccttctggggccatgcctggctctcagcaggctgccctgagcacactgcactgctcttctgtcctcgcctgactcccctgcctcagtggcagcagcccccagcccaggacctgcacagaggaggcgtctgtcagcgacccaacctgagccccagagaggagcactgggtaccacacagccccaagatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttga

SEQ ID NO: 137975 - DNA, 2597 bp, Homo sapiens
  Payload ID: 7022
  Gene Symbol: GATM
  Gene Name: glycine amidinotransferase (L-arginine:glycine amidinotransferase)
  Uniprot ID: P50440
  ENST ID: ENST00000396659
  CDS Start-End: 341-1612
aacgggccttcttgcgacgctcgggtctgggtccgggtccggacgtgcaacagaagccgtcagtggccccgctggctaaaaaagggcaagcatcggaggctcgagccagcggccgcggcgcttcccgacagttcctaattcggggcgctacgccggccccaccacctgttcccggcagccaatggggccgcggggggcggccggggcggagcgcggctacaaaaggcctcgggccccgcgcgcccgcccaccccgctccgggcgcgctctcgggaaggcttggaccgacgcggcccagaggccaggaacattccgcgcgtggaccagccgggccagggcgatgctgcgggtgcggtgtctgcgcggcgggagccgcggcgccgaggcggtgcactacatcggatctcggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcattactcctccaacaccaatcatcccagacgatcatccactctggatgtcatccaaatggctttccatgaatgtcttaatgctagatgaaaaacgtgttatggtggatgccaatgaagttccaattcaaaagatgtttgaaaagctgggtatcactaccattaaagttaacattcgtaatgccaattccctgggaggaggcttccattgctggacctgcgatgtccggcgccgaggcaccttacagtcctacttggactgaacaggcctgatggagcttgtggctggcctcagatacacctaagaagcttaggggcaaggttcattctcctgctttaaaaagtgcatgaactgtagtgctttaaacaatcatctccttaacaggggtcgtaagcctggtttgcttctattacttttctttgacataaagaaaataacttctgctaggtattactctctactcctaaagttatttactatttggcttcaagtataaaattttggtgaatgtgtaccaagaaaaaattagtcacctgagtaacttggccactaataattaaccatctacctctgtttttaattttctttccaaaaggcagcttgaaatgttggtcctaatcttaattttttttcctcttctatagacttgagaatgtttttctctaaatgagagaaagacttagaatgtacacagatccaaaatagaatcagattatctctttttttctaaaggagagaaagacttagaacatacacagatcctaagtagaaccaggtaattgtctctttttctaataaggaatttgggtaatttttaattttttgttttttaaaaaataacctagactatgcaaaacatcaaagtgaattttccatgaatgtttttaatattctcatctcaacattgtgatatatgctactaaaaaccttttcatatacatcttacctcatttcaagtgaattattttaatctttttctctctttccaaaaatttaggaatgtttagtgtaattggatttcgctatcagttcccatccttaagttttgatattcaatatctgatagatacactgcatctttggtcatctaagatttgtttacaaatgtgcaaattatttagagcatagactttataagcattaaaaaaaactaatggaggtaaaacctaaatgcgatgtgaaataattttagtgttgataccgtatgtgtatttttattctaataaacttttgtgttccagattgaa

SEQ ID NO: 137976 - DNA, 554 bp, Homo sapiens
  Payload ID: 7022
  Gene Symbol: GATM
  Gene Name: glycine amidinotransferase (L-arginine:glycine amidinotransferase)
  ENST ID: ENST00000558118
  CDS Start-End: 32-322
attccgcgcgtggaccagccgggccagggcgatgctgcgggtgcggtgtctgcgcggcgggagccgcggcgccgaggcggtgcactacatcggatctcggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaagtagagacggggtttcaccgtgttagccaggatggtctcgatctcctgacctcgtgatccacacgccttggcctcccaaagtgctgggattgcaggggccaacacatatgaaaagtactggccattttaccagaagcaaggagggcattattttcccaaagatcatttgaaaaaggctgttgctgaaattgaagaaatgtgcaatattttaaaaacggaaggagtgacagtaagga

SEQ ID NO: 137977 - DNA, 579 bp, Homo sapiens
  Payload ID: 7022
  Gene Symbol: GATM
  Gene Name: glycine amidinotransferase (L-arginine:glycine amidinotransferase)
  ENST ID: ENST00000559885
  CDS Start-End: 535-579
tagataagaagacaatttgtagataaacaagagggttaaaaaaattatctgtaatcccactacccacctacacactgttaacgtcttggtttatgctgttctaaaggggtttaagtggcaatgttatgctggatttttactccatctccacttcctcctctctgtaagtactgatagagcaatgcaatacaataatcttttctttgttcttggaagcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcct

SEQ ID NO: 137978 - DNA, 493 bp, Homo sapiens
  Payload ID: 7022
  Gene Symbol: GATM
  Gene Name: glycine amidinotransferase (L-arginine:glycine amidinotransferase)
  ENST ID: ENST00000558537
  CDS Start-End: 398-493
accggaccttggtgcgctgcaccaagcttcccgctcggagcaaggggttgggacgacggaggctcctcttagtaaaaggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacg

SEQ ID NO: 137979 - DNA, 569 bp, Homo sapiens
  Payload ID: 7022
  Gene Symbol: GATM
  Gene Name: glycine amidinotransferase (L-arginine:glycine amidinotransferase)
  ENST ID: ENST00000558163
  CDS Start-End: 67-569
aaggcttggaccgacgcggcccagaggccaggaacattccgcgcgtggaccagccgggccagggcgatgctgcgggtgcggtgtctgcgcggcgggagccgcggcgccgaggcggtgcactacatcggatctcgggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctca

SEQ ID NO: 137980 - DNA, 903 bp, Homo sapiens
  Payload ID: 7022
  Gene Symbol: GATM
  Gene Name: glycine amidinotransferase (L-arginine:glycine amidinotransferase)
  ENST ID: ENST00000561148
  CDS Start-End: 810-903
aaatcgagttgcctaacccagagctttcccgagatggtcttcgttacaggtgtctgggaggcggcttaagctcacttcactaggtcattaagcatgtactttggtggttacatatatcttggaagtcaccggctttacattctgttttcctggccttcgaactggagcatcagtactaccgccgttggaatagcaacctagagactttgctattttgtgaagaaactctaactatccgcatgggcacagaattttgggtgctctggtgcaaatgtctcagttctggaggctgggaagtcaaagacaaggcactggcagattccatgactggaaaggagagaaggtctctgaggaagtgacattccagctgagacgtgaaggataagtagaaaccaagcagaagaattggaagaggaaagggaagagggaaaagcctgtgccaatgccctgagattggaatatgctttttgtgtttaagaaattaacagaagcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtcta

SEQ ID NO: 137981 - DNA, 1522 bp, Homo sapiens
  Payload ID: 7022
  Gene Symbol: GATM
  Gene Name: glycine amidinotransferase (L-arginine:glycine amidinotransferase)
  Uniprot ID: P50440
  ENST ID: ENST00000558336
  CDS Start-End: 95-1270
cccaccccgctccgggcgcgctctcgggaaggcttggaccgacgcggcccagaggccaggaacattccgcgcgtggaccagccgggccagggcgatgctgcgggtgcggtgtctgcgcggcgggagccgcggcgccgaggcggtgcactacatcggatctcggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcattactcctccaacaccaatcatcccagacgatcatccactctggatgtcatccaaatggctttccatgaatgtcttaatgctagatgaaaaacgtgttatggtggatgccaatgaagttccaattcaaaagatgtttgaaaagctgggtatgtacaacaaatgaaacatgttgtcatacatgaaaacgttaaatgagaagaactaaagaaatgacatgctaggtttgataaatggtttgtctaattcaattttgattccttttagaggcaccaagttattatttcacagaaagtcagtatttttattttcaacacacgtagccccaacaagttggagatgcatcctgagctcctgagacatccccttaacaataagtttataaatcttatatgacttagccaacgttttggtgccc

SEQ ID NO: 137982 - DNA, 1497 bp, Homo sapiens
  Payload ID: 7023
  Gene Symbol: GCAT
  Gene Name: glycine C-acetyltransferase
  Uniprot ID: O75600
  ENST ID: ENST00000248924
  CDS Start-End: 57-1316
gtccgcgatgcgcacggctcccaggcaggcaggcgcgctcgggcgaggtaggagcgatgtggcctgggaacgcctggcgcgccgcactcttctgggtgccccgcggccgccgcgcacagtcagcgctggcccagctgcgtggcattctggagggggagctggaaggcatccgcggagctggcacttggaagagtgagcgggtcatcacgtcccgtcaggggccgcacatccgcgtggacggcgtctccggaggaatccttaacttctgtgccaacaactacctgggcctgagcagccaccctgaggtgatccaggcaggtctgcaggctctggaggagtttggagctggcctcagctctgtccgctttatctgtggaacccagagcatccacaagaatctagaagcaaaaatagcccgcttccaccagcgggaggatgccatcctctatcccagctgttatgacgccaacgccggcctctttgaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccagaagcatcggctgcgcctggtggccactgatggggccttttccatggatggcgacatcgcacccctgcaggagatctgctgcctcgcctctagatatggtgccctggtcttcatggatgaatgccatgccactggcttcctggggcccacaggacggggcacagatgagctgctgggtgtgatggaccaggtcaccatcatcaactccaccctggggaaggccctgggtggagcatcagggggctacacgacagggcctgggcccctggtgtccctgctgcggcagcgcgcccggccatacctcttctccaacagtctgccacctgctgtcgttggctgcgcctccaaggccctagatctgctgatggggagtaacaccattgtccagtctatggctgccaagacccagaggttccgtagtaagatggaagctgctggcttcactatctcgggagccagtcaccccatctgccctgtgatgctgggtgatgcccggctggcctctcgcatggcggatgacatgctgaagagaggcatctttgtcatcgggttcagctaccccgtggtccccaagggcaaggcccggatccgggtacagatctcagcagtgcatagcgaggaagacattgaccgctgcgtggaggccttcgtggaagtggggcgactgcacggggcactgccctgagctctgggtaaggacgagaagagccaaggtccgcctactgccacagggtcaaaggaggttttcgatcagcccagaccagaggctctgagccctgaaccaaagtcccagagctgggctgggacgtgacctgtgctgagggctgtgagaatgtgaaacaacagtgtgaaaattggctgtgaca

SEQ ID NO: 137983 - DNA, 1656 bp, Homo sapiens
  Payload ID: 7023
  Gene Symbol: GCAT
  Gene Name: glycine C-acetyltransferase
  Uniprot ID: O75600
  ENST ID: ENST00000323205
  CDS Start-End: 64-1401
aggctgcgtccgcgatgcgcacggctcccaggcaggcaggcgcgctcgggcgaggtaggagcgatgtggcctgggaacgcctggcgcgccgcactcttctgggtgccccgcggccgccgcgcacagtcagcgctggcccagctgcgtggcattctggagggggagctggaaggcatccgcggagctggcacttggaagagtgagcgggtcatcacgtcccgtcaggggccgcacatccgcgtggacggcgtctccggagggcctggcactgtcatctttccaggcctgcccttgccccacctgagctgctgtatccatctcctctccttcacctcaggaatccttaacttctgtgccaacaactacctgggcctgagcagccaccctgaggtgatccaggcaggtctgcaggctctggaggagtttggagctggcctcagctctgtccgctttatctgtggaacccagagcatccacaagaatctagaagcaaaaatagcccgcttccaccagcgggaggatgccatcctctatcccagctgttatgacgccaacgccggcctctttgaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccagaagcatcggctgcgcctggtggccactgatggggccttttccatggatggcgacatcgcacccctgcaggagatctgctgcctcgcctctagatatggtgccctggtcttcatggatgaatgccatgccactggcttcctggggcccacaggacggggcacagatgagctgctgggtgtgatggaccaggtcaccatcatcaactccaccctggggaaggccctgggtggagcatcagggggctacacgacagggcctgggcccctggtgtccctgctgcggcagcgcgcccggccatacctcttctccaacagtctgccacctgctgtcgttggctgcgcctccaaggccctagatctgctgatggggagtaacaccattgtccagtctatggctgccaagacccagaggttccgtagtaagatggaagctgctggcttcactatctcgggagccagtcaccccatctgccctgtgatgctgggtgatgcccggctggcctctcgcatggcggatgacatgctgaagagaggcatctttgtcatcgggttcagctaccccgtggtccccaagggcaaggcccggatccgggtacagatctcagcagtgcatagcgaggaagacattgaccgctgcgtggaggccttcgtggaagtggggcgactgcacggggcactgccctgagctctgggcccagtcctgtggccggttgaagaatcaggcaggagccagggctctgaggggaggcgcctgaggactgcagatctccactgacctctttccctagattaagatgggacccagtggccgggcacggtggctcaggcctgtaatcccagcactttgggaggccaaggtaggcggatcacctgaggtcgggagtttgagaccagcctgaccaacatggagaaaccccgtctctactaaaaatacgaaatt

SEQ ID NO: 137984 - DNA, 716 bp, Homo sapiens
  Payload ID: 7023
  Gene Symbol: GCAT
  Gene Name: glycine C-acetyltransferase
  ENST ID: ENST00000451984
  CDS Start-End: 1-716
gcggccgccgcgcacagtcagcgctggcccagctgcgtggcattctggagggggagctggaaggcatccgcggagctggcacttggaagagtgagcgggtcatcacgtcccgtcaggggccgcacatccgcgtggacggcgtctccggaggaatccttaacttctgtgccaacaactacctgggcctgagcagccaccctgaggtgatccaggcaggtctgcaggctctggaggagtttggagctggcctcagctctgtccgctttatctgtggaacccagagcatccacaagaatctagaagcaaaaatagcccgcttccaccagcgggaggatgccatcctctatcccagctgttatgacgccaacgccggcctctttgagagcagggcgctggtccagcccggcactgagacacgggggccccagagagaagcacagaacaccttgcctctctacccagaggagcgccctggctggcagtacagttttttgatttgctggagtcccggtcaagggagaagcccagggtggttaaatgatggctctacgctcactgcctccctccaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccag

SEQ ID NO: 137985 - DNA, 558 bp, Homo sapiens
  Payload ID: 7023
  Gene Symbol: GCAT
  Gene Name: glycine C-acetyltransferase
  ENST ID: ENST00000426858
  CDS Start-End: 31-306
aggcaggcgcgctcgggcgaggtaggagcgatgtggcctgggaacgcctggcgcgccgcactcttctgggtgccccgcggccgccgcgcacagtcagcgctggcccagctgcgtggcattctggagggggagctggaaggcatccgcggagctggcacttggaagagtgagcgggtcatcacgtcccgtcaggggccgcacatccgcgtggacggcgtctccggagagcatccacaagaatctagaagcaaaaatagcccgcttccaccagcgggaggatgccatcctctatcccagctgttatgacgccaacgccggcctctttgaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccagaagcatcggctgcgcctggtggccactgatggggccttttccatggatggcgacatcgcacccctgcaggagatctgctgcct

SEQ ID NO: 137986 - DNA, 583 bp, Homo sapiens
  Payload ID: 7023
  Gene Symbol: GCAT
  Gene Name: glycine C-acetyltransferase
  ENST ID: ENST00000445195
  CDS Start-End: 53-583
gcgatgcgcacggctcccaggcaggcaggcgcgctcgggcgaggtaggagcgatgtggcctgggaacgcctggcgcgccgcactcttctgggtgccccgcggccgccgcgcacagtcagcgctggcccagctgcgtggcattctggagggggagctggaaggcatccgcggagctggcacttggaagagtgagcgggtcatcacgtcccgtcaggggccgcacatccgcgtggacggcgtctccggagggcctggcactgtcatctttccaggcctgcccttgccccacctgagctgctgtatccatctcctctccttcacctcaggaatccttaacttctgtgccaacaactacctgggcctgagcagccaccctgaggtgatccaggcaggtctgcaggctctggaggagtttggagctggcctcagctctgtccgctttatctgtggaacccagagcatccacaagaatctagaagcaaaaatagcccgcttccaccagcgggaggatgccatcctctatcccagctgttatgacgccaacgccggcctctttgagagcagggcgctggtccagcccggc

SEQ ID NO: 137987 - DNA, 1552 bp, Homo sapiens
  Payload ID: 7024
  Gene Symbol: GCSH
  Gene Name: glycine cleavage system protein H (aminomethyl carrier)
  Uniprot ID: P23434
  ENST ID: ENST00000315467
  CDS Start-End: 126-647
cccgcggcaccgcctccgcgcctccatccagccggctccctccggccgcgaactgcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgtcacccgccgcgccctgcccgccgaggccctggcagctgggggtgggcgccgtccgtacgctgcgcactggacccgctctgctctcggtgcgtaaattcacagagaaacacgaatgggtaacaacagaaaatggcattggaacagtgggaatcagcaattttgcacaggaagcgttgggagatgttgtttattgtagtctccctgaagttgggacaaaattgaacaaacaagatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaatcatgtttgttttgatgttaatatttcatttagtaactctgctagtatttgtgaaagtgctaactttaacttacggaaagttactttttaaaaggaaatttaagccagaacaatgcaaagctccaagaaaatgttttctttagtcacaaatctggtttttcttaagccaagatctgtcacctttaacataataaaaaataaatcaccaactttgattttctatcatgcgaggtctgaagaaagaagaggaaagacagaggaaggtggaagttttgatcagtatagcacatggtgtttttaagttgttaaaccacgttcaggtttccacttaagtcatgggaataaaagtggacaaggactgaa

SEQ ID NO: 137988 - DNA, 592 bp, Homo sapiens
  Payload ID: 7024
  Gene Symbol: GCSH
  Gene Name: glycine cleavage system protein H (aminomethyl carrier)
  ENST ID: ENST00000566566
  CDS Start-End: 22-510
gacccccgcacccctgcgaacatggcgctgcgagtggtgcggagcgtgcgggccctgctctgcaccctgcgcgcggtcccgtcacccgccgcgccctgcccgccgaggccctggcagctgggggtgggcgccgtccgtacgctgcgcactggacccgctctgctctcggtgcgtaaattcacagagaaacacgaatgggtaacaacagaaaatggcattggaacagtgggaatcagcaattttgcacaggaagcgttgggagatgttgtttattgtagtctccctgaagttgggacaaaattgaacaaacaagatgagtttggtgctttggaaagtgtgaaagctgctagtgaactctattctcctttatcaggagaagtaactgaaattaatgaagctcttgcagaaaatccaggacttgtaaacaaatcttgttatgaagatggtaagctgttgctagaaatttctcaaggaattactactacagtaaatattttatctagaatttaaagcaagtttagctgattgtgacttcatctttttctacttcttggtactaaatagagatgttctgctttaaaagaaaaacaga

SEQ ID NO: 137989 - DNA, 792 bp, Homo sapiens
  Payload ID: 7024
  Gene Symbol: GCSH
  Gene Name: glycine cleavage system protein H (aminomethyl carrier)
  ENST ID: ENST00000564477
  CDS Start-End: 41-193
ggccgaggcgtagcgctgcgacccccgcacccctgcgaacatggcgctgcgagtggtgcggagcgtgcgggccctgctctgcaccctgcgcgcggtcccgtcacccgccgcgccctgcccgccgaggccctggcagctgggggtgggcgccgtccgtacgctgcgcactggacccgctctgctctcgggttaaatcatttcttatatgagccatctttatgctgcctccctaaacctcatcaccccaaatttgtcttcagaggcacagatttttttttctgcaagacagaccagtaatatgcgtaaattcacagagaaacacgaatgggtaacaacagaaaatggcattggaacagtgggaatcagcaattttgcacaggaagcgttgggagatgttgtttattgtagtctccctgaagttgggacaaaattgaacaaacaagatgagtttggtgctttggaaagtgtgaaagctgctagtgaactctattctcctttatcaggagaagtaactgaaattaatgaagctcttgcagaaaatccaggacttgtaaacaaatcttgttatgaagatggtaagctgttgctagaaatttctcaaggaattactactacagtaaatattttatctagaatttaaagcaagtttagctgattgtgacttcatctttttctacttcttggtactaaatagagatgttctgctttaaaagaaaaacagaggttagttgaatacttaaagttatgtttaagatttctggctaggcgcagtggctcgcgcctgtgatccca

SEQ ID NO: 137990 - DNA, 645 bp, Homo sapiens
  Payload ID: 7024
  Gene Symbol: GCSH
  Gene Name: glycine cleavage system protein H (aminomethyl carrier)
  ENST ID: ENST00000569885
  CDS Start-End: 1-199
ctgcaccctgcgcgcggtcccgtcacccgccgcgccctgcccgccgaggccctggcagctgggggtgggcgccgtccgtacgctgcgcactggacccgctctgctctcggtgcgtaaattcacagagaaacacgaatgggtaacaacagaaaatggcattggaacagtgggaatcagcaattttgcacaggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatt

SEQ ID NO: 137991 - DNA, 972 bp, Homo sapiens
  Payload ID: 7024
  Gene Symbol: GCSH
  Gene Name: glycine cleavage system protein H (aminomethyl carrier)
  ENST ID: ENST00000564386
  CDS Start-End: 1-239
tgcggagcgtgcgggccctgctctgcaccctgcgcgcggtcccgtcacccgccgcgccctgcccgccgaggccctggcagctgggggtgggcgccgtccgtacgctgcgcactggacccgctctgctctcggtgcgtaaattcacagagaaacacgaatgggtaacaacagaaaatggcattggaacagtgggaatcagcaattttgcacagatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaata

SEQ ID NO: 137992 - DNA, 400 bp, Homo sapiens
  Payload ID: 7024
  Gene Symbol: GCSH
  Gene Name: glycine cleavage system protein H (aminomethyl carrier)
  ENST ID: ENST00000561801
  CDS Start-End: 1-131
agcgtgcgggccctgctctgcaccctgcgcgcggtcccgtcacccgccgcgccctgcccgccgaggccctggcagctgggggtgggcgccgtccgtacgctgcgcactggacccgctctgctctcggatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagcca

SEQ ID NO: 137993 - DNA, 3767 bp, Homo sapiens
  Payload ID: 7025
  Gene Symbol: GLDC
  Gene Name: glycine dehydrogenase (decarboxylating)
  Uniprot ID: P23378
  ENST ID: ENST00000321612
  CDS Start-End: 152-3214
cccgcgagcgtccatccatctgtccggccgactgtccagcgaaaggggctccaggccgggcgcagccgccacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctgtccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttctcctctttttctgtgtgaggtttttttttttttaatctgcatttattagtattctaataaaagcatcttgatcggaagaa

SEQ ID NO: 137994 - DNA, 1072 bp, Homo sapiens
  Payload ID: 7026
  Gene Symbol: GNMT
  Gene Name: glycine N-methyltransferase
  Uniprot ID: Q14749
  ENST ID: ENST00000372808
  CDS Start-End: 11-898
gcggcgcaggatggtggacagcgtgtaccggacccgctccctgggggtggcggccgaagggctcccggaccagtacgcggacggggaggcggcgcgcgtgtggcagctgtatatcggagacacccgcagccgcaccgccgagtacaaggcatggctgcttgggctgctgcgccagcacggctgccagcgggtgctcgacgtagcctgtggcactggggtggactccattatgctggtggaagagggcttcagtgtgacgagtgtggatgccagtgacaagatgctgaagtatgcacttaaggagcgctggaaccggcggcacgagcccgccttcgacaagtgggtcatcgaagaagccaactggatgactctggacaaagatgtgccccagtcagcagagggtggctttgatgctgtcatctgccttggaaacagtttcgctcacttgccagactgcaaaggggaccagagtgagcaccggctggcgctgaaaaacattgcgagcatggtgcgggcagggggcctactggtcattgatcatcgcaactacgaccacatcctcagtacaggctgtgcacccccagggaagaacatctactataagagtgacttgaccaaggacgtcacaacatcagtgctgatagtgaacaacaaggcccacatggtgaccctggactatacggtgcaggtgccgggggctggccaggatggctctcctggcttgagtaagttccggctctcctactacccacactgtctggcatccttcacggagctgctccaagcagccttcggaggtaagtgccagcacagcgtcctgggcgacttcaagccttacaagccaggccaaacctacattccctgctacttcatccacgtgctcaagaggacagactgagtgtggcctcagctcccacaagcctctgcccaggcactgctaggctctgtctggaagatggggaccagcagccccacaccagggccagcctctagagcagactacagctggggtgcagggatgtgggttccacagacggaagggtaaacaatatagtctttttcagttcctgca

SEQ ID NO: 137995 - DNA, 1803 bp, Homo sapiens
  Payload ID: 7027
  Gene Symbol: GLRA1
  Gene Name: glycine receptor, alpha 1
  Uniprot ID: P23415
  ENST ID: ENST00000274576
  CDS Start-End: 294-1643
gggagccaacagacacgctggagtttaacaaacagcaatactcttcgcgctcctgaaaagcaggtctggacgctctccgtggtgctgaaacgcctcgcagccgccgctgtccgtggtatctacgaccccctcgctccaatttcccctggggctctccctccgcgcccctgttccccgcctccctttaacatctggattattttttgcaatagcgctttctggttttgtaagtgccaatttgaaacatttttgcccccataactcgtggactacaaagcacaaggacctgaaaaatgtacagcttcaatactcttcgactctacctttgggagaccattgtattcttcagccttgctgcttctaaggaggctgaagctgctcgctccgcacccaagcctatgtcaccctcggatttcctggataagctaatggggagaacctccggatatgatgccaggatcaggcccaattttaaaggtcccccagtgaacgtgagctgcaacattttcatcaacagctttggttccattgctgagacaaccatggactatagggtcaacatcttcctgcggcagcaatggaacgacccccgcctggcctataatgaataccctgacgactctctggacctggacccatccatgctggactccatctggaaacctgacctgttctttgccaacgagaagggggcccacttccatgagatcaccacagacaacaaattgctaaggatctcccggaatgggaatgtcctctacagcatcagaatcaccctgacactggcctgccccatggacttgaagaatttccccatggatgtccagacatgtatcatgcaactggaaagctttggatatacgatgaatgacctcatctttgagtggcaggaacagggagccgtgcaggtagcagatggactaactctgccccagtttatcttgaaggaagagaaggacttgagatactgcaccaagcactacaacacaggtaaattcacctgcattgaggcccggttccacctggagcggcagatgggttactacctgattcagatgtatattcccagcctgctcattgtcatcctctcatggatctccttctggatcaacatggatgctgcacctgctcgtgtgggcctaggcatcaccactgtgctcaccatgaccacccagagctccggctctcgagcatctctgcccaaggtgtcctatgtgaaagccattgacatttggatggcagtttgcctgctctttgtgttctcagccctattagaatatgctgccgttaactttgtgtctcggcaacataaggagctgctccgattcaggaggaagcggagacatcacaaggaggatgaagctggagaaggccgctttaacttctctgcctatgggatgggcccagcctgtctacaggccaaggatggcatctcagtcaagggcgccaacaacagtaacaccaccaacccccctcctgcaccatctaagtccccagaggagatgcgaaaactcttcatccagagggccaagaagatcgacaaaatatcccgcattggcttccccatggccttcctcattttcaacatgttctactggatcatctacaagattgtccgtagagaggacgtccacaaccagtgaagggtctgaaaggttgggggaggctgggagaggggaacgtgggaatagcacaggaatctgagagactaaggaagagaaggggaacggagggagggggcacacttacacaactctctctgcaatatgtgcaatagcaaaatgcagtgatgcatgaatttta

SEQ ID NO: 137996 - DNA, 1707 bp, Homo sapiens
  Payload ID: 7027
  Gene Symbol: GLRA1
  Gene Name: glycine receptor, alpha 1
  Uniprot ID: P23415
  ENST ID: ENST00000455880
  CDS Start-End: 288-1661
caacagacacgctggagtttaacaaacagcaatactcttcgcgctcctgaaaagcaggtctggacgctctccgtggtgctgaaacgcctcgcagccgccgctgtccgtggtatctacgaccccctcgctccaatttcccctggggctctccctccgcgcccctgttccccgcctccctttaacatctggattattttttgcaatagcgctttctggttttgtaagtgccaatttgaaacatttttgcccccataactcgtggactacaaagcacaaggacctgaaaaatgtacagcttcaatactcttcgactctacctttgggagaccattgtattcttcagccttgctgcttctaaggaggctgaagctgctcgctccgcacccaagcctatgtcaccctcggatttcctggataagctaatggggagaacctccggatatgatgccaggatcaggcccaattttaaaggtcccccagtgaacgtgagctgcaacattttcatcaacagctttggttccattgctgagacaaccatggactatagggtcaacatcttcctgcggcagcaatggaacgacccccgcctggcctataatgaataccctgacgactctctggacctggacccatccatgctggactccatctggaaacctgacctgttctttgccaacgagaagggggcccacttccatgagatcaccacagacaacaaattgctaaggatctcccggaatgggaatgtcctctacagcatcagaatcaccctgacactggcctgccccatggacttgaagaatttccccatggatgtccagacatgtatcatgcaactggaaagctttggatatacgatgaatgacctcatctttgagtggcaggaacagggagccgtgcaggtagcagatggactaactctgccccagtttatcttgaaggaagagaaggacttgagatactgcaccaagcactacaacacaggtaaattcacctgcattgaggcccggttccacctggagcggcagatgggttactacctgattcagatgtatattcccagcctgctcattgtcatcctctcatggatctccttctggatcaacatggatgctgcacctgctcgtgtgggcctaggcatcaccactgtgctcaccatgaccacccagagctccggctctcgagcatctctgcccaaggtgtcctatgtgaaagccattgacatttggatggcagtttgcctgctctttgtgttctcagccctattagaatatgctgccgttaactttgtgtctcggcaacataaggagctgctccgattcaggaggaagcggagacatcacaagagccccatgttgaatctattccaggaggatgaagctggagaaggccgctttaacttctctgcctatgggatgggcccagcctgtctacaggccaaggatggcatctcagtcaagggcgccaacaacagtaacaccaccaacccccctcctgcaccatctaagtccccagaggagatgcgaaaactcttcatccagagggccaagaagatcgacaaaatatcccgcattggcttccccatggccttcctcattttcaacatgttctactggatcatctacaagattgtccgtagagaggacgtccacaaccagtgaagggtctgaaaggttgggggaggctgggagaggggaacgtgggaat

SEQ ID NO: 137997 - DNA, 1555 bp, Homo sapiens
  Payload ID: 7027
  Gene Symbol: GLRA1
  Gene Name: glycine receptor, alpha 1
  ENST ID: ENST00000462581
  CDS Start-End: 288-401
caacagacacgctggagtttaacaaacagcaatactcttcgcgctcctgaaaagcaggtctggacgctctccgtggtgctgaaacgcctcgcagccgccgctgtccgtggtatctacgaccccctcgctccaatttcccctggggctctccctccgcgcccctgttccccgcctccctttaacatctggattattttttgcaatagcgctttctggttttgtaagtgccaatttgaaacatttttgcccccataactcgtggactacaaagcacaaggacctgaaaaatgtacagcttcaatactcttcgactctacctttgggagaccattgtattcttcaggtcccccagtgaacgtgagctgcaacattttcatcaacagctttggttccattgctgagacaaccatggactatagggtcaacatcttcctgcggcagcaatggaacgacccccgcctggcctataatgaataccctgacgactctctggacctggacccatccatgctggactccatctggaaacctgacctgttctttgccaacgagaagggggcccacttccatgagatcaccacagacaacaaattgctaaggatctcccggaatgggaatgtcctctacagcatcagaatcaccctgacactggcctgccccatggacttgaagaatttccccatggatgtccagacatgtatcatgcaactggaaagctttggatatacgatgaatgacctcatctttgagtggcaggaacagggagccgtgcaggtagcagatggactaactctgccccagtttatcttgaaggaagagaaggacttgagatactgcaccaagcactacaacacaggtaaattcacctgcattgaggcccggttccacctggagcggcagatgggttactacctgattcagatgtatattcccagcctgctcattgtcatcctctcatggatctccttctggatcaacatggatgctgcacctgctcgtgtgggcctaggcatcaccactgtgctcaccatgaccacccagagctccggctctcgagcatctctgcccaaggtgtcctatgtgaaagccattgacatttggatggcagtttgcctgctctttgtgttctcagccctattagaatatgctgccgttaactttgtgtctcggcaacataaggagctgctccgattcaggaggaagcggagacatcacaaggaggatgaagctggagaaggccgctttaacttctctgcctatgggatgggcccagcctgtctacaggccaaggatggcatctcagtcaagggcgccaacaacagtaacaccaccaacccccctcctgcaccatctaagtccccagaggagatgcgaaaactcttcatccagagggccaagaagatcgacaaaatatcccgcattggcttccccatggccttcctcattttcaacatgttctactggatcatctacaagattgtccgtagagaggacgtccacaaccagtgaagggtctgaaaggttgggggaggctgggagaggggaacgtgggaat

SEQ ID NO: 137998 - DNA, 3216 bp, Homo sapiens
  Payload ID: 7028
  Gene Symbol: GLRA2
  Gene Name: glycine receptor, alpha 2
  Uniprot ID: P23416
  ENST ID: ENST00000218075
  CDS Start-End: 531-1889
acgtctccgtctcattctatagccctcattccagcacaggatctcagcaatttttccctcttccccccacccactccagcgcgcagagtcctttcttctctctcatttacaacttctttttaaaagaaaacattttctagaaaaagggctttgctaaacagaaaagatataaaacaaaagccacagctatctagcatggcattgtcaccaactccctttgcatggtgatgcgattaaggtagcagcatttttattattcaggaaaagcagctgggggattcatcagttctgaggctttgtctttctgggttaactgatggtcccaagcctcggtttgacctgaccatgatgcccaggactggcactttttcttttttctcagcaaactgtacaaaaccaaatctctttttgattttcaaggaaactaggttcctgccaaattttgaatctggacaataaacagacactttgtcctagcatctttctggaatcatttcgggatattttccacaagcaacacagaaacaggaatgaaccggcagctagtgaacattttgacagccttgtttgcatttttcttagagacaaaccacttcaggacggctttctgcaaagaccatgactccaggtctggaaaacaaccttcacagaccctatctccttcagatttcttggacaagttaatgggaaggacatcaggatatgatgcaagaatcaggccaaattttaaaggtcctccagtaaacgttacttgcaatatttttatcaacagttttggatcagtcacagaaacgaccatggactaccgagtgaatatttttctgagacaacagtggaatgattcacggctggcgtacagtgagtacccagatgactccctggacttggacccatccatgctagactccatttggaaaccagatttgttctttgccaatgagaagggtgccaacttccacgatgtcaccactgacaacaaattgctacggatttcgaaaaatggcaaagtgctctacagtatcagactcaccttgaccttatcctgtcccatggacttgaagaactttccgatggatgtccagacctgtacaatgcagctggagagttttgggtacacgatgaatgacctgatatttgagtggttaagtgatggtccagtgcaagttgctgaaggattgaccctgccccagtttattttgaaagaagagaaggaacttggctactgtacaaagcactacaacactggaaagtttacctgcattgaggtcaagtttcatctggaacgccaaatgggatattatttgatccagatgtacatcccaagcctgcttatagtaattttgtcctgggtttccttttggataaatatggatgcagcccctgccagggtcgcactgggcatcaccacagtcttaacgatgaccacccagagttcaggctccagggcatctctgccaaaggtctcctatgtaaaagcgattgacatctggatggcggtgtgccttctgtttgtgtttgctgccttactggaatacgcagcggtgaacttcgtctccaggcaacacaaggagttcctgcgcctccgaagaagacagaagaggcagaataaggaagaagacgttactcgtgaaagtcgttttaattttagcggttatgggatgggtcactgcctccaagtgaaagatggaacagctgtcaaggccacacctgccaacccactcccacaaccgccaaaagatggagatgctatcaagaagaagtttgtggaccgggcaaaaaggattgacacgatatctcgagctgccttcccattggccttcctcattttcaacatcttttactggatcacatacaagatcattcggcatgaagatgtccacaagaaatagatgtgccctacagaccctgggaccttcttgcctcagtgttgtgcttgtaaatacacagtgaaattgtctttatatcactttgacagaggagaagattgagggaggggggagggagggtcatgggggtgggtttcctggcacctacatgaaaaaaaagacaagttatatgggtgatgaagaaaactgcacaaaattaaggggttgcagaatcacgggagcataataattcccttccataatctttagcattgttctttcagtcagacatgatatgcgcaacattcagacatgatatgcgcatcattcagacatgatatgcggggtcaagttcttaagggctgtttgccttttggtccttttggtttggtttggctttgactaattctggtactgaaaagttagctatacacacacacacacacacacacacacacacacacacacacacacacacacacacacacaaacttcaaaaatgcttaaccatctgaccatagtgactagcctatagtgagtcgaggaccaaactttttcaggaaaatgctgcctcgtttttaaaacaagcctcctaagctatgttctttacaatgtctgtaattagtgtttcacttgagaaagccttttgtgggtcgtaaattatttctacttatccagtaaataacaatgacaaaataaacaccaatgacagaaaaatttctactttactgtccatataggtgtgcattttaatatttttctttccaagataaaattttgaaacttaaattgtgtattgtgtaattaatttgatagtgtaccctcttaataaatgcccactttattttatatccaagttagtgcattatatatatatttttgctttggctatatttacacgtgactttaatcgcccaactgtgactagtcattgcagctactcagctacagtatttatggagatggtgtgtcctgaacagtgtagctcaggtcagcttgaactttccatttctgctctcattgtaggtgtaactactagtcctaatgtcaactgacccatgatttctactgtcagtcaatataagtgaacattgttttaaatatccttaactaacttaaagaattttaaaattgtactgtgattttcataacccgttgcctttttggtaccagagctacgtggtttgaattctggctacatgttttaagtaagaaaaaaaaagacgtatttttgcttactcagataaaagacaacctgtaaaaatataataattaaattttacatgtgctgtacaaggggttattttaaaaagcatttgttcaatttcaataaagctaagtgtgccgcaaa

SEQ ID NO: 137999 - DNA, 1730 bp, Homo sapiens
  Payload ID: 7028
  Gene Symbol: GLRA2
  Gene Name: glycine receptor, alpha 2
  Uniprot ID: P23416
  ENST ID: ENST00000355020
  CDS Start-End: 287-1645
gcatttttattattcaggaaaagcagctgggggattcatcagttctgaggctttgtctttctgggttaactgatggtcccaagcctcggtttgacctgaccatgatgcccaggactggcactttttcttttttctcagcaaactgtacaaaaccaaatctctttttgattttcaaggaaactaggttcctgccaaattttgaatctggacaataaacagacactttgtcctagcatctttctggaatcatttcgggatattttccacaagcaacacagaaacaggaatgaaccggcagctagtgaacattttgacagccttgtttgcatttttcttagagacaaaccacttcaggacggctttctgcaaagaccatgactccaggtctggaaaacaaccttcacagaccctatctccttcagatttcttggacaagttaatgggaaggacatcaggatatgatgcaagaatcaggccaaattttaaagggcctcctgtaaatgttacctgcaacatatttatcaacagctttgggtcaatagcagaaactacaatggactaccgagtgaatatttttctgagacaacagtggaatgattcacggctggcgtacagtgagtacccagatgactccctggacttggacccatccatgctagactccatttggaaaccagatttgttctttgccaatgagaagggtgccaacttccacgatgtcaccactgacaacaaattgctacggatttcgaaaaatggcaaagtgctctacagtatcagactcaccttgaccttatcctgtcccatggacttgaagaactttccgatggatgtccagacctgtacaatgcagctggagagttttgggtacacgatgaatgacctgatatttgagtggttaagtgatggtccagtgcaagttgctgaaggattgaccctgccccagtttattttgaaagaagagaaggaacttggctactgtacaaagcactacaacactggaaagtttacctgcattgaggtcaagtttcatctggaacgccaaatgggatattatttgatccagatgtacatcccaagcctgcttatagtaattttgtcctgggtttccttttggataaatatggatgcagcccctgccagggtcgcactgggcatcaccacagtcttaacgatgaccacccagagttcaggctccagggcatctctgccaaaggtctcctatgtaaaagcgattgacatctggatggcggtgtgccttctgtttgtgtttgctgccttactggaatacgcagcggtgaacttcgtctccaggcaacacaaggagttcctgcgcctccgaagaagacagaagaggcagaataaggaagaagacgttactcgtgaaagtcgttttaattttagcggttatgggatgggtcactgcctccaagtgaaagatggaacagctgtcaaggccacacctgccaacccactcccacaaccgccaaaagatggagatgctatcaagaagaagtttgtggaccgggcaaaaaggattgacacgatatctcgagctgccttcccattggccttcctcattttcaacatcttttactggatcacatacaagatcattcggcatgaagatgtccacaagaaatagatgtgccctacagaccctgggaccttcttgcctcagtgttgtgcttgtaaatacacagtgaaattgtctttatatcactttgaca

SEQ ID NO: 138000 - DNA, 3182 bp, Homo sapiens
  Payload ID: 7028
  Gene Symbol: GLRA2
  Gene Name: glycine receptor, alpha 2
  Uniprot ID: P23416
  ENST ID: ENST00000443437
  CDS Start-End: 767-1858
acttccctcaccctctccgtctcccgacctctcttctcctcttgctgtcatcgtacccccttcagtatcccctcgctgaacggccagtcactctttgccttcgaacagcaggcacgtcccctcttgaatgcttttccccgacccccgccccaagcaactgaaaaaggaaacatgcgcacttcagagcttggagctgtccgagtgctgaaatttataggctgggaaactaggttcctgccaaattttgaatctggacaataaacagacactttgtcctagcatctttctggaatcatttcgggatattttccacaagcaacacagaaacaggaatgaaccggcagctagtgaacattttgacagccttgtttgcatttttcttagagacaaaccacttcagaaccaagataaatggaacacatagtaataatgctatgaatactgggaaaacccactatgttcctttcaggtttacacctcctactatgattaagaaaaaatataggctggtttttattagaatcatcatcatcatcatcatcctcaccaccaccaccatcataatcaaataatacttgattaatcagatgaatctgcatatgagaatgacggctttctgcaaagaccatgactccaggtctggaaaacaaccttcacagaccctatctccttcagatttcttggacaagttaatgggaaggacatcaggatatgatgcaagaatcaggccaaattttaaagttttggatcagtcacagaaacgaccatggactaccgagtgaatatttttctgagacaacagtggaatgattcacggctggcgtacagtgagtacccagatgactccctggacttggacccatccatgctagactccatttggaaaccagatttgttctttgccaatgagaagggtgccaacttccacgatgtcaccactgacaacaaattgctacggatttcgaaaaatggcaaagtgctctacagtatcagactcaccttgaccttatcctgtcccatggacttgaagaactttccgatggatgtccagacctgtacaatgcagctggagagttttgggtacacgatgaatgacctgatatttgagtggttaagtgatggtccagtgcaagttgctgaaggattgaccctgccccagtttattttgaaagaagagaaggaacttggctactgtacaaagcactacaacactggaaagtttacctgcattgaggtcaagtttcatctggaacgccaaatgggatattatttgatccagatgtacatcccaagcctgcttatagtaattttgtcctgggtttccttttggataaatatggatgcagcccctgccagggtcgcactgggcatcaccacagtcttaacgatgaccacccagagttcaggctccagggcatctctgccaaaggtctcctatgtaaaagcgattgacatctggatggcggtgtgccttctgtttgtgtttgctgccttactggaatacgcagcggtgaacttcgtctccaggcaacacaaggagttcctgcgcctccgaagaagacagaagaggcagaataaggaagaagacgttactcgtgaaagtcgttttaattttagcggttatgggatgggtcactgcctccaagtgaaagatggaacagctgtcaaggccacacctgccaacccactcccacaaccgccaaaagatggagatgctatcaagaagaagtttgtggaccgggcaaaaaggattgacacgatatctcgagctgccttcccattggccttcctcattttcaacatcttttactggatcacatacaagatcattcggcatgaagatgtccacaagaaatagatgtgccctacagaccctgggaccttcttgcctcagtgttgtgcttgtaaatacacagtgaaattgtctttatatcactttgacagaggagaagattgagggaggggggagggagggtcatgggggtgggtttcctggcacctacatgaaaaaaaagacaagttatatgggtgatgaagaaaactgcacaaaattaaggggttgcagaatcacgggagcataataattcccttccataatctttagcattgttctttcagtcagacatgatatgcgcaacattcagacatgatatgcgcatcattcagacatgatatgcggggtcaagttcttaagggctgtttgccttttggtccttttggtttggtttggctttgactaattctggtactgaaaagttagctatacacacacacacacacacacacacacacacacacacacacacacacacacacacacacaaacttcaaaaatgcttaaccatctgaccatagtgactagcctatagtgagtcgaggaccaaactttttcaggaaaatgctgcctcgtttttaaaacaagcctcctaagctatgttctttacaatgtctgtaattagtgtttcacttgagaaagccttttgtgggtcgtaaattatttctacttatccagtaaataacaatgacaaaataaacaccaatgacagaaaaatttctactttactgtccatataggtgtgcattttaatatttttctttccaagataaaattttgaaacttaaattgtgtattgtgtaattaatttgatagtgtaccctcttaataaatgcccactttattttatatccaagttagtgcattatatatatatttttgctttggctatatttacacgtgactttaatcgcccaactgtgactagtcattgcagctactcagctacagtatttatggagatggtgtgtcctgaacagtgtagctcaggtcagcttgaactttccatttctgctctcattgtaggtgtaactactagtcctaatgtcaactgacccatgatttctactgtcagtcaatataagtgaacattgttttaaatatccttaactaacttaaagaattttaaaattgtactgtgattttcataacccgttgcctttttggtaccagagctacgtggtttgaattctggctacatgttttaagtaagaaaaaaaaagacgtatttttgcttactcagataaaagacaacctgtaaaaatataataattaaattttacatgtgctgtacaaggggttattttaaaaagcatttgttcaatttcaataaagctaagtgtgccgc

SEQ ID NO: 138001 - DNA, 659 bp, Homo sapiens
  Payload ID: 7028
  Gene Symbol: GLRA2
  Gene Name: glycine receptor, alpha 2
  ENST ID: ENST00000415367
  CDS Start-End: 14-659
cttgattaatcagatgaatctgcatatgagaatgacggctttctgcaaagaccatgactccaggtctggaaaacaaccttcacagaccctatctccttcagatttcttggacaagttaatgggaaggacatcaggatatgatgcaagaatcaggccaaattttaaaggtcctccagtaaacgttacttgcaatatttttatcaacagttttggatcagtcacagaaacgaccatggactaccgagtgaatatttttctgagacaacagtggaatgattcacggctggcgtacagtgagtacccagatgactccctggacttggacccatccatgctagactccatttggaaaccagatttgttctttgccaatgagaagggtgccaacttccacgatgtcaccactgacaacaaattgctacggatttcgaaaaatggcaaagtgctctacagtatcagactcaccttgaccttatcctgtcccatggacttgaagaactttccgatggatgtccagacctgtacaatgcagctggagagttttgggtacacgatgaatgacctgatatttgagtggttaagtgatggtccagtgcaagttgctgaaggattgaccctgccccagtttattttgaaagaagagaaggaacttggctact

SEQ ID NO: 138002 - DNA, 8770 bp, Homo sapiens
  Payload ID: 7029
  Gene Symbol: GLRA3
  Gene Name: glycine receptor, alpha 3
  Uniprot ID: O75311
  ENST ID: ENST00000274093
  CDS Start-End: 504-1898
gtcgacaggaccgggttgtccggccccacccccgcttccctttgccgcgctccgggtctcgggttttaacccaaggtggagagctggattccggcgggcggcgcttggagcaggtggagaggcgtcctctttccggctgttgctgctcttcttcctccaatcctgggtctcagtcagggaagaacgaacattcttcctttgctgctggagctttagagaactgttgcccagcacctaggcacttcagacatttcatctcactcatttttgtaatttcactgtaaaaatcacctgcacatttataacactgtgactctccacttctgctcaatgctgagaaggggtccgcatactgcggggagctgtctaaggtgctgaagcttcccaagcatcagtctacaccaacaccatgcggggttagattgtacattttcattctgtctttctggttccccatgccttggataagactattttcaggatcgtgaatatctctccgtatcatggcccacgtgagacactttcggacattagtttcgggattttacttctgggaagcagcactgttactcagtttggttgccacaaaggaaacagacagtgcaagatctcgaagtgctccaatgtcaccttctgattttctggataaattaatgggcaggacatcaggatatgatgcaagaatcagacccaattttaaaggccctccagttaatgtcacatgcaacatattcatcaacagctttggctctatcgcagagacgaccatggattacagagtgaatatctttcttcgtcagaaatggaatgatccccgcctcgcgtacagtgaatatcctgacgactctttagacctcgacccctccatgttggactccatttggaaacctgatttgttctttgccaatgaaaagggtgccaactttcatgaagtcactacagacaacaaattgctaagaattttcaaaaatggaaatgttctttattcaataagattaacattaacactttcctgtccaatggatctcaagaattttcccatggatgtacaaacatgtataatgcaactggaaagctttgggtacacaatgaatgatctcatttttgaatggcaagatgaggcacccgtacaagtggcagaaggactcactttgccccagtttctgttgaaagaagaaaaagatttacgatactgcactaaacattacaatacaggaaagtttacgtgtatagaagtgcgattccatctggagcgacaaatgggatactatctgatccagatgtacattcccagtctcctgattgttattctatcctgggtttcattctggatcaacatggatgcagcaccggccagggtagctctggggataaccactgtgctaacgatgactacacagagttcaggatcacgagcttccttgccaaaagtttcatatgtcaaagctattgatatttggatggcagtatgcctcctttttgtgttttcagcacttctggagtatgcagctgtaaattttgtatcaagacaacacaaagaacttctgagatttcgacgaaagagaaagaataagacagaagcttttgcactggagaagttttaccgtttctcagatatggatgatgaggtaagggaaagccgattcagcttcacagcctatggaatgggaccatgtctacaagcaaaggatggcatgactccaaagggccccaaccaccctgtccaggtaatgccaaaaagtcctgatgaaatgaggaaggtctttatcgaccgggccaagaagattgataccatctcccgagcctgcttcccattagcttttttgatttttaatattttctactgggttatctataaaattcttaggcatgaggatattcatcagcagcaagattaagtctctgggggcatgcaaatgcaaatggtcaattcagaagaaagtgtctctgccataggtgtgtatgtgtatatgtgtgcgtgtggtatacaaatgatgaccattgtattaaaatggcatatggaaaagctttgtattttggttagctatgcaaagtcatgagaaagatgagattcttttaatgaatataaaatatttattaggggattctatttcatattaattccaggtgatttgttttttcacagtaaaccatgtaagtggaagctttactgccaatgtgtttatatgttatataatatctcataatagtagacatgaaaactactttgaaattccttgatttgtaattcaatgctattaaatcatacaaaagcaaattttgcacagtaaaccaatagtttgagatttaaaactattttcttatagtatagttacaaaatgggaaaataattagttacagtgggaaattcactcatattaatggaggattgtacatataaatactatttaaacaacatatgtaattttgaaaatttttaaataagagcattaaaagactttaatgatttggaatactaaatttaattgtttagaatattaagttttcctctgtgcaaatttaaaacaaataacaagagatcgtgttacagtcacaatctacttttcttaaactttgtatctctaggaacgaaggtggaaatacgggaaacaactttgtttttaaataagtattatagctatgtatttttagttattgccaaacattgaacaattcaagccagcacccttgtttttgttagacttttaatagctacttaactgtatgtgattgtgtttaataatttgatataacaggacaaaattcagtaagacttttatattttagtttagaatgtgactttaaaattcaatgggattaaagtatttacattttgataaaaatgaatacaatgaaaacaaaatggattcatggaagattttttaataaaaaccattttcccatcaatgttttatgggtctcaactcctatctccaaatataagtagggaaagttttaattttaaatgatataagtaagtcatttctataaagtgaggactctttttctatttctgaattaatgatttcaaaatctaagccattcgcaagatgtgaataattttaaatgaaatttttacataaaatttttcaatgaccccatgggattacttcaacaaaaacagagcattagtaacttgttttttgcagtgtaattgggtgcaaatgtatgatagagttcttggtaaacagaaccagactctgactctttttcagttttgctatttttttaactatttttaccataaatttatttggaaaagctttggaatgctttttaggtattttaattattggtcagatgcacaaactcagtccaccaaattattcacagagaaaactttaaagattaagaaaacaatgaactcagatgtacaatagaaaagccagttctttaacaagatgctattttctacccttcaaccactttcaaattaaaagcaaaaactaccatttaaaactaaaacctttacaatgttattgtacatcagcttatacaattgtaattttttaaaataacattttaaaaaatagtaaatgttaagcagtttttgctagtaaaagaccaagttcccctcctttataagtaacttaaaacaacactataaggaaataatatcatgtttggcattatgtgcaaatgacacaaccaaaagaatttgttactctgtaagtacccacgttgaggactgtgcacctgaaaattaaacatatgcttcttcatttggtgtgtatttaacaaaaccatggaaacatattcttgttctaaagattagagcaagatatgtcatttgtattccttgagaattagcaggagagtttgaggtaattataaactacatcatctcgatgtgtctctgaaatacctgaatacgtttttctatactttccacatcttatttcaaaagtttcccaacattgcttaagtgaattctgccaggagcaaacagaaatataatgaatgcaaacatgcttacttccaaaagaaattcacagacatcacttctttccatatttgagaatattataaatgtgtctttgttaaatcagaaacttagaaagtgaaaataccaaacatgagacaatattgtcaacaaggacgttggtacattagaaatctatctcaaaagtattacactttccttaggcatagttttcctttcctattatatttgtcactgtcttactgcactaagaaaatactttaacagctttcactcacaaggcaacagtgacaaggtgcatgtggctgaatccaatatgtttaaaggaatgtgtctcctccttcgaactcttatagaccttttaaaactgaaaaattacattgcagttagcatcctgagataatatttgcctcaataagccctgtgtccaaccagaatattttaaattaaaccaaccacaaaattattaatggcaagaaattaaaaatgtgtgcatatacattaactactaaacacacaaattggaattccaatgtgcatattctgaagtattttaaaatagccacattagaaaatatgggattttcatgtatgcagtttatatcattttcttaaaaagaattatttgtatgtcaatcattgaaatatttgattccatagcatatgaatttataggctatcttatacattagcatatatgtgcccaaccttttctttctttcccaaccattagaattgaacttaaaccataatgaggctctagaacttactttacaactttaaatagattcaagagtcactgtattttcaagaaagctgagggtgtttaaaacttctccaacccttccaaaagtttctccatggcgctggagaccccatccaactctcagtggctatattagggaatcatccggactgctcatcttattctaaaattaattcttattctgttgatatattctaataacttttatcttaatttggaatttaattgcttgtatatttatatatccctaagacatgaattcatgtattagtttatgaatacccaggatctcatggaaggtaagggaaattttagaaaaaaaaatgaataatctaaatgtttaactaacagaagagagcaagctgttcactactttagtactcagtgcaacttaagtagttataatatttgaaaaaagatttagatgtatcttccatactatacatccctttttctgaacattttttattccactttttaaaatatgcttttctatttttctcaacacaacatacttcaacctgctggttacttgggaggactgaatattatactggcagctaaatttttatttcatctataaagtacacattccaggaaatggacatgagagaatacaagagacttgccaaaattgaaatggaaaatacttgcagtattttgtaaatggaaaagaaggaaactgacagcattgtttttcacaggtgtcccctaaaaatttagaacactctaagaacaaaactctgagaacaaaaatgtatctaatgatccttagacagatatcattaacaatccttgaggtcatgatatcttctactccaaaagtgattccacactctttgcaacatagataatagcataaactcccaaaatttatcagcatatacgacctatatttttcatctagttaatattgaactagcaaagaaaagcaagccattccaaatataagacaatctggtgttaatacaatatattagaagaaatagtgtaaatgttcacacagattccctcttgcaaataaagtacccataatacccattgcatcttgtacctgtataagagacatcttcctcagcagatgcattggtttttatttccttatttgtgtgctacagtggtaaatatagcctcactgcattttttttattgttatataaacctttcatggataaataagcagtgtacactgtaaattgcattaatttaattaactttaaaattaaacttttatctcagcccccattcctctttacaaacatagtgatattaaaaagtgaacttccatagggagacacctggtactccaattacttcaaaagtaaagtgatgcatattcttccataacaaagatacttataggccatgtgtaaaatataactctctacaatttaaacggaactagggcagggaaaaatatcctggggaagcttcttccagatatgaggacaagagatataatcccaagttagtagctaggacccacttacctgtttttttggtctacattttacatcttaataatgccttcatctcttccctttccctctctctctctctctttcacacacacacacacacacacacacacacacacacacatacacatattggtaatgagatgaattcctttagattaaaaatacaaagacagtcaatttttctagacaaaggttcataatcctgtgatatgttttgcaatattaagtgattcctggtggaaaatatgaaccatgcagtcattcgatttggccagctcttaatcatgcaacaatcttttgcctcaaaaacacataaacaaagctaactggatcaagtctttaacccttaacaatcgaattctaaaacactatttgaaccgtttttgaagaacagctaaataactgtcaaaaacctttttcaaaagacagctagtaatattggatgactttgtagtgtctgaacaggtggttttctcagtagtttttgtggttaacacataaacaaagaggagacatttaaggtgatggagtattatttttaaaaagtgattttgaaccctggctatgtgttggaattccttacacattttaaaaatacatacatatgcttggtgtccaacatagaagattatgatttaatcattgattaaacaaatattcattgagtaccttatgtgtgcctggcactgtcccaagtgctaaatttagtatttttggaataagatctgaaattctggatgattgaaaaaattccagaagtgagagaattcgtgtgaacttacacaagcttattctcttaataaggatcaatttaacactttttaagttttatcattttttctttcttcaagcaactaattttagttgtctctcatttatattcttagaattaaaaataggcccggccaggtggctcacgcctgtaatcccagcactttgggaggccgaggcagtcaaatcacttgaggtcaggagttaagacaccagcctggccaatatgataaaaccctgtctctactaaaaatacaaaaattagccaggcatgatggcaggtgcctgtaatcccagttactcaagggaggctgaggtggaagaatggcttgagcccaggagatggaggttgcagtgagccaagatcgcaccactgcactccaaactgggtgacagagtgagactctgtctcacaaacaaacagacagacaaaaaaagaatttaaaataaatctttgatgcgtttcaattcagctttcctcccaatgtcagaatcttcaccattacattatccacattcttcgagcacccagatagcaacaggtagctcattactctgagggcagtcttctgttccattgtgacataactctagatgataaaaatgttaatcttcatcaagaaatgacttttacttcctaaaataccaagtaagtttattcccctcctataagacaactagcatatattttcacatttctgctgtctgtgtttaagttcaatcaaccccttatcactagctttattcttatttaaaccattcatgagagcattgtaagtgttaaacaatgatgagatattttcaggcttataaaataatgaaatataaaattaattatctacatagataaatagaaattgatgaaaatttctatgtatattattttcagtaactgttaatgtcttcctataacagcaataaatttaaattaaatatttttaaatttatttcagatatgaagatattatataaaactctacaaagtaatatgaatttaaaaaaactagcagcaaaccatattaaccatattgtgtgtttttagagtaaagctataacaaaagtacaggggattaagttgttttattttaatagctgcttttactctggggtggttttagcaatggcgcctttgggcaaccccgctcacatacacagtatccagcctgggtggttaatactagggagctgtgacttaaatggcaggaaaggattcagatgtaaaattgtacttgaatatgcttgaataattttgcacttcttcacttttttctctatgaattattcaatggtcattacttaaatttgtattttaatgtatgataaatgataatatggggggggaaatagagtgaagtaccctgacattctacagatataatatgatatgctatgaaaaacaaaacaaaaagaaaatgtgccatatattttccatgtaccatctttatatgatatacagtgacttcattattagtgagtcaagttgtttaaaggactaccaaaagaagtattgctattttatggtttttatggtgtaaattatttttctgtcttcttgagtcttatgtctaagtctgtcttccttgtccagatgctgtcatatttttccaggaaattatactgaaaacatatttaaaaatttatgcacgatttcatcaacttgtttttcattatattatatttagttcaattttgcaactaacagactctctatcagagtcattaacctgtgaacagtataaagtatttaacatgtaactatagataatttgatccgaaacaataaaaatgaacacttttcaagaatatgga

SEQ ID NO: 138003 - DNA, 3065 bp, Homo sapiens
  Payload ID: 7029
  Gene Symbol: GLRA3
  Gene Name: glycine receptor, alpha 3
  Uniprot ID: O75311
  ENST ID: ENST00000340217
  CDS Start-End: 417-1766
attccggcgggcggcgcttggagcaggtggagaggcgtcctctttccggctgttgctgctcttcttcctccaatcctgggtctcagtcagggaagaacgaacattcttcctttgctgctggagctttagagaactgttgcccagcacctaggcacttcagacatttcatctcactcatttttgtaatttcactgtaaaaatcacctgcacatttataacactgtgactctccacttctgctcaatgctgagaaggggtccgcatactgcggggagctgtctaaggtgctgaagcttcccaagcatcagtctacaccaacaccatgcggggttagattgtacattttcattctgtctttctggttccccatgccttggataagactattttcaggatcgtgaatatctctccgtatcatggcccacgtgagacactttcggacattagtttcgggattttacttctgggaagcagcactgttactcagtttggttgccacaaaggaaacagacagtgcaagatctcgaagtgctccaatgtcaccttctgattttctggataaattaatgggcaggacatcaggatatgatgcaagaatcagacccaattttaaaggccctccagttaatgtcacatgcaacatattcatcaacagctttggctctatcgcagagacgaccatggattacagagtgaatatctttcttcgtcagaaatggaatgatccccgcctcgcgtacagtgaatatcctgacgactctttagacctcgacccctccatgttggactccatttggaaacctgatttgttctttgccaatgaaaagggtgccaactttcatgaagtcactacagacaacaaattgctaagaattttcaaaaatggaaatgttctttattcaataagattaacattaacactttcctgtccaatggatctcaagaattttcccatggatgtacaaacatgtataatgcaactggaaagctttgggtacacaatgaatgatctcatttttgaatggcaagatgaggcacccgtacaagtggcagaaggactcactttgccccagtttctgttgaaagaagaaaaagatttacgatactgcactaaacattacaatacaggaaagtttacgtgtatagaagtgcgattccatctggagcgacaaatgggatactatctgatccagatgtacattcccagtctcctgattgttattctatcctgggtttcattctggatcaacatggatgcagcaccggccagggtagctctggggataaccactgtgctaacgatgactacacagagttcaggatcacgagcttccttgccaaaagtttcatatgtcaaagctattgatatttggatggcagtatgcctcctttttgtgttttcagcacttctggagtatgcagctgtaaattttgtatcaagacaacacaaagaacttctgagatttcgacgaaagagaaagaataaggatgatgaggtaagggaaagccgattcagcttcacagcctatggaatgggaccatgtctacaagcaaaggatggcatgactccaaagggccccaaccaccctgtccaggtaatgccaaaaagtcctgatgaaatgaggaaggtctttatcgaccgggccaagaagattgataccatctcccgagcctgcttcccattagcttttttgatttttaatattttctactgggttatctataaaattcttaggcatgaggatattcatcagcagcaagattaagtctctgggggcatgcaaatgcaaatggtcaattcagaagaaagtgtctctgccataggtgtgtatgtgtatatgtgtgcgtgtggtatacaaatgatgaccattgtattaaaatggcatatggaaaagctttgtattttggttagctatgcaaagtcatgagaaagatgagattcttttaatgaatataaaatatttattaggggattctatttcatattaattccaggtgatttgttttttcacagtaaaccatgtaagtggaagctttactgccaatgtgtttatatgttatataatatctcataatagtagacatgaaaactactttgaaattccttgatttgtaattcaatgctattaaatcatacaaaagcaaattttgcacagtaaaccaatagtttgagatttaaaactattttcttatagtatagttacaaaatgggaaaataattagttacagtgggaaattcactcatattaatggaggattgtacatataaatactatttaaacaacatatgtaattttgaaaatttttaaataagagcattaaaagactttaatgatttggaatactaaatttaattgtttagaatattaagttttcctctgtgcaaatttaaaacaaataacaagagatcgtgttacagtcacaatctacttttcttaaactttgtatctctaggaacgaaggtggaaatacgggaaacaactttgtttttaaataagtattatagctatgtatttttagttattgccaaacattgaacaattcaagccagcacccttgtttttgttagacttttaatagctacttaactgtatgtgattgtgtttaataatttgatataacaggacaaaattcagtaagacttttatattttagtttagaatgtgactttaaaattcaatgggattaaagtatttacattttgataaaaatgaatacaatgaaaacaaaatggattcatggaagattttttaataaaaaccattttcccatcaatgttttatgggtctcaactcctatctccaaatataagtagggaaagttttaattttaaatgatataagtaagtcatttctataaagtgaggactctttttctatttctgaattaatgatttcaaaatctaagccattcgcaagatgtgaataattttaaatgaaatttttacataaaatttttcaatgaccccatgggattacttcaacaaaaacagagcattagtaacttgttttttgcagtgtaattgggtgcaaatgtatgatagagttcttggtaaacagaaccag

SEQ ID NO: 138004 - DNA, 1795 bp, Homo sapiens
  Payload ID: 7030
  Gene Symbol: GLRA4
  Gene Name: glycine receptor, alpha 4
  Uniprot ID: Q5JXX5
  ENST ID: ENST00000372617
  CDS Start-End: 422-1675
gtgcctttaaattactgctttcggagggtgcatctagggggaggtgggaggcaggaaaacatcttcctaccggtctccctcctccctcccctccaagactcttcagggtttggagagtgattgctgcccagagagaatcttttccagctcccagctggcaggctaaggccctccggagcccaaggcgagcccaagcagaagccagtagggttatctgtgtcaggatcatttccaggggaatagttctggcccctggcaggtaaagacaggccagaggagaagaggcagaagaggagagaaagcaggctcttttgcgagcagcccaggttggagaaaggctctgtacttttggcgttcctgcagggatatcccctctcacattggcagccaggctgagaaagggcttcaagatccccgcagaatgacaactcttgttcctgcaaccctctccttccttcttctctggaccctgccagggcaggtcctcctcagggtggccttggcaaaagaggaagtcaaatctggaaccaaggggtcccagcccatgtccccctctgatttcctagacaaacttatggggcgaacatctggatatgatgccaggattcggcccaattttaaaggcccacccgtgaacgtgacctgcaacatcttcatcaacagtttcagctccatcaccaagaccacaatggactaccgggtgaatgtcttcttgcggcaacagtggaatgacccacgcctgtcctaccgagaatatcctgatgactctctggacctcgatccctccatgctggactctatctggaagccagacctcttctttgctaatgagaaaggggccaacttccatgaggtgaccacggacaacaagttactgcgcatcttcaagaatgggaatgtgctgtacagcatcaggctgaccctcattttgtcctgcctgatggacctcaagaacttccccatggacatccagacctgcacgatgcagcttgagagctttggctacaccatgaaagacctcgtgtttgagtggctggaagatgctcctgctgtccaagtggctgaggggctgactctgccccagtttatcttgcgggatgagaaggatctaggctgttgtaccaagcactacaacacagggaaattcacctgcatcgaggtaaagtttcacctggaacggcagatgggctactatctgattcagatgtacatccccagcctactcatcgtcatcctgtcctgggtctccttctggatcaacatggatgctgcccctgcccgtgtgggcctgggcatcaccaccgtgctcaccatgaccacccagagctctggctcccgggcctctttgcctaaggtgtcctacgtgaaggcaatcgacatctggatggctgtgtgtctgctctttgtgttcgctgccttgctggagtatgctgccataaattttgtttctcgtcagcataaagaattcatacgacttcgaagaaggcagaggcgccaacgcttggaggaagatatcatccaagaaagtcgtttctatttccgtggctatggcttgggccactgcctgcaggcaagagatggaggtccaatggaaggttctggcatttatagtccccaacctccagcccctcttctaagggaaggagaaaccacgcggaaactctacgtggactgagccaagagaattgacaccatctcccgggctgtcttccctttcactttcctcatcttcaatatcttctactgggttgtctataaagtgctatggtcagaagatatccaccaggctctgtga

SEQ ID NO: 138005 - DNA, 1812 bp, Homo sapiens
  Payload ID: 7030
  Gene Symbol: GLRA4
  Gene Name: glycine receptor, alpha 4
  ENST ID: ENST00000436213
  CDS Start-End: 453-587
gctctgaaccccactccagctgctgccgactgtgcctttaaattactgctttcggagggtgcatctagggggaggtgggaggcaggaaaacatcttcctaccggtctccctcctccctcccctccaagactcttcagggtttggagagtgattgctgcccagagagaatcttttccagctcccagctggcaggctaaggccctccggagcccaaggcgagcccaagcagaagccagtagggttatctgtgtcaggatcatttccaggggaatagttctggcccctggcaggtaaagacaggccagaggagaagaggcagaagaggagagaaagcaggctcttttgcgagcagcccaggttggagaaaggctctgtacttttggcgttcctgcagggatatcccctctcacattggcagccaggctgagaaagggcttcaagatccccgcagaatgacaactcttgttcctgcaaccctctccttccttcttctctggaccctgccagggcaggtcctcctcagcaggcaggtggcaggtggccagaagcagcagcagcacctggctagcgtggacatcctgtggtgaagtcacagacttctgcttgctccagcaccaccaccagcctccttggattttcagagcctgcctctgtccccaggggtggccttggcaaaagaggaagtcaaatctggaaccaaggggtcccagcccatgtccccctctgatttcctagacaaacttatggggcgaacatctggatatgatgccaggattcggcccaattttaaaggcccacccgtgaacgtgacctgcaacatcttcatcaacagtttcagctccatcaccaagaccacaatggactaccgggtgaatgtcttcttgcggcaacagtggaatgacccacgcctgtcctaccgagaatatcctgatgactctctggacctcgatccctccatgctggactctatctggaagccagacctcttctttgctaatgagaaaggggccaacttccatgaggtgaccacggacaacaagttactgcgcatcttcaagaatgggaatgtgctgtacagcatcaggtgcaccgggtggatagccaggagagtttgcgttaaggggaagaatttggatgaagactgaggggtgggaggagggttcccttgcactgtgatgggccccagtaagccgatgtcacttctttcttactgtccccactaggctgaccctcattttgtcctgcctgatggacctcaagaacttccccatggacatccagacctgcacgatgcagcttgagagctttggctacaccatgaaagacctcgtgtttgagtggctggaagatgctcctgctgtccaagtggctgaggggctgactctgccccagtttatcttgcgggatgagaaggatctaggctgttgtaccaagcactacaacacaggtgtcctacgtgaaggcaatcgacatctggatggctgtgtgtctgctctttgtgttcgctgccttgctggagtatgctgccataaattttgtttctcgtcagcataaagaattcatacgacttcgaagaaggcagaggcgccaacgcttggaggaagatatcatccaagaaagtcgtttctatttccgtggctatggcttgggccactgcctgcaggcaagagatggaggtccaatggaaggttctggcatttatagtccccaacctccagcccctcttctaagggaaggagaaaccacgcggaaactctacgtggactgagccaagagaattgacaccatctcccgggctgtcttccctttcac

SEQ ID NO: 138006 - DNA, 3126 bp, Homo sapiens
  Payload ID: 7031
  Gene Symbol: GLRB
  Gene Name: glycine receptor, beta
  Uniprot ID: P48167
  ENST ID: ENST00000264428
  CDS Start-End: 271-1764
ccgcccgcggtcgccaggttcccccgcggcccgcgctgtccccgctgcggccccgaccgcggcgcgccacggcgcaggctccgcggcccgagcaggcgcgtcagccgagctcggcggtggcgcgggcggctgggacgcagctgcccccgctcggcgcccgctgcacccttagcagccactgccacctgggcccggagcctccacgatctcgcccggcgattgtgggcaggggcgcctccggatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatctcagcagtcagcagaggaccttgcccgagtacctgccaactccactagcaatatcttgaacaggttattggtcagttatgatcccaggataagaccaaacttcaaaggcattcctgttgatgtagtagtcaacatttttattaacagttttggatccattcaagaaacaacaatggactatagagttaacatcttcctgagacaaaaatggaatgaccccaggctgaagctccccagtgattttaggggttcagatgcactgacagtggatccaacaatgtacaagtgtttatggaaacctgatttattttttgcaaatgaaaaaagtgccaattttcatgatgtgacccaggaaaacatcctcctctttatttttcgtgatggagatgtccttgtcagcatgaggttatctattactctttcatgccctttggacttgacattgtttcccatggatacacaacgttgcaagatgcaactggagagctttggttacacaactgatgatttacgatttatctggcagtcaggagatcctgtgcaattagaaaaaattgccttgcctcaatttgatatcaaaaaggaagatattgaatatggtaactgtacaaaatactataaaggcacgggctactacacatgcgtggaagtcatcttcaccctgaggaggcaggtcggcttttacatgatgggggtctacgccccaactctgctcattgttgttctctcctggctttccttctggatcaacccggacgcgagtgctgccagagtgcccctgggtatcttctcagtcctcagcttggcctctgagtgcacaacccttgccgctgagcttcccaaagtttcctatgtgaaggctcttgatgtttggcttattgcttgccttctctttgggtttgcttccctggtggagtatgcagttgtccaggtgatgctgaacaaccccaaaagggttgaagctgaaaaagccagaattgctaaggctgagcaagcagatggaaaaggtggaaatgtggctaaaaagaatactgtgaatggaacagggactcctgttcatattagcactttgcaggttggtgagaccagatgcaaaaaagtttgtacttctaagtctgatctgagatctaatgacttcagcattgttggaagcttaccaagagattttgaactatccaattatgactgctatggaaaacccattgaagttaacaacggacttgggaaatctcaggctaagaacaacaagaagcctccccctgcgaaacctgttattccaacagcagcaaagcgaattgatctttatgcaagagcattgtttcctttctgcttcttgttcttcaatgttatatattggtctatatatttatgataaatcttttccatttgtacaaaataaaattccatttcattgtgacctactcctttcataaatgccaatctgtgagaacttttgaattttcatagcaacattgcattttggatgccatttgattgtaataaaactgtggcaccttaattttgaatggcagcatgatcatgtaatatctgtgctctaataacgatgtatatatgtatagtgaacatattgcttagtaacaaatgaaggacaagcatactacataatataatccatacaattctcttcagttagtgtaaactgcaaatactacagataattctgataataaaatgatatgcacgctgaatcctgctatggtcaccattctaatgtatgtagtatttcaaatttccttccttgtaactttcaaagaaagccatcttattcttgtaaaattttagatggtattatcacagatttaaaaaggttgtattacatattgtttaaactttgtaagtagaaatatatctgttataattatacaggctctgtggagaaataaagttcaaaatatattaatttgtaaaatcagctcgttttaaagtgtgcttgtgttgtcaaaaatatcagatagtaatacacagtgagcatttttaaacaaagggaaacctatatttatgtaactgtatactgaattctgacaaaataaaaaaagataccttattgacgaaatatttaggataaacaaaattctatttaatccaccttaaaacctaaatgtattttcatggatttcatttgttggtacatattacacaaaacattgtgccttaaaatgagtcatacatcttttaaattggaatgcagtaatagatatgtgattttacatcatttttaagaaaccaaggggaagtaataagttgaaaaagaaatccataactattaaaagattttaacttttttattttattaaaatgcttgcatattttaagtaaaattaaaaatgtttactgaatttatttttttatttgaatattttgggattagttacaaaatatttagagattaaataaataatagctttgtttgtgttagacttcacttctacttgtattttctttcttgttaaaagtctagacaactgagatttacttactttgaacttgttccaatccaaaagtaagcactaagtctcattttatgagaccaccatttcttaatatcacatccagtgcacctttgtctttctgccatatctgaaataaaactatcagtaattcacatagataaacataagactaaagaagtatatttacattatctggagagttttgttgcagctacgagtttgtatggcaaattcaataataaagtattgtttatgcaaattgc

SEQ ID NO: 138007 - DNA, 574 bp, Homo sapiens
  Payload ID: 7031
  Gene Symbol: GLRB
  Gene Name: glycine receptor, beta
  ENST ID: ENST00000515642
  CDS Start-End: 162-302
ctcggcggtggcgcgggcggctgggacgcagctgcccccgctcggcgcccgctgcacccttagcagccactgccacctgggcccggagcctccacgatctcgcccggcgattgtgggcaggggcgcctccggatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatcagagagattgtaccattgaatgacagcattttcatacttcagtctgtatgtactaagaaggaatgcaatggcttcagcagtcagcagaggaccttgcccgagtacctgccaactccactagcaatatcttgaacaggttattggtcagttatgatcccaggataagaccaaacttcaaaggcattcctgttgatgtagtagtcaacatttttattaacagttttggatccattcaagaaacaacaatggactatagagttaacatcttcctgagacaaaaatggaatgacc

SEQ ID NO: 138008 - DNA, 858 bp, Homo sapiens
  Payload ID: 7031
  Gene Symbol: GLRB
  Gene Name: glycine receptor, beta
  ENST ID: ENST00000506411
  CDS Start-End: 124-264
cgctcggcgcccgctgcacccttagcagccactgccacctgggcccggagcctccacgatctcgcccggcgattgtgggcaggggcgcctccggatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatcagagagattgtaccattgaatgacagcattttcatacttcagtctgtatgtactaagaaggtcagcagtcagcagaggaccttgcccgagtacctgccaactccactagcaatatcttgaacaggttattggtcagttatgatcccaggataagaccaaacttcaaaggcattcctgttgatgtagtagtcaacatttttattaacagttttggatccattcaagaaacaacaatggactatagagttaacatcttcctgagacaaaaatggaatgaccccaggctgaagctccccagtgattttaggggttcagatgcactgacagtggatccaacaatgtacaagtgtttatggaaacctgatttattttttgcaaatgaaaaaagtgccaattttcatgatgtgacccaggaaaacatcctcctctttatttttcgtgatggagatgtccttgtcagcatgaggttatctattactctttcatgccctttggacttgacattgtttcccatggatacacaacgttgcaagatgcaactggagagctttggttacacaactgatgatttacgatttatctggcagtcaggagatcctgtgcaattagaaaa

SEQ ID NO: 138009 - DNA, 728 bp, Homo sapiens
  Payload ID: 7031
  Gene Symbol: GLRB
  Gene Name: glycine receptor, beta
  ENST ID: ENST00000512619
  CDS Start-End: 133-303
agctgcccccgctcggcgcccgctgcacccttagcagccactgccacctgggcccggagcctccacgatctcgcccggcgattgtgggcaggggcgcctccggatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatcgttggtgagaccagatgcaaaaaagtttgtacttctaagtctgatctgagatctaatgacttcagcattgttggaagcttaccaagagattttgaactatccaattatgactgctatggaaaacccattgaagttaacaacggacttgggaaatctcaggctaagaacaacaagaagcctccccctgcgaaacctgttattccaacagcagcaaagcgaattgatctttatgcaagagcattgtttcctttctgcttcttgttcttcaatgttatatattggtctatatatttatgataaatcttttccatttgtacaaaataaaattccatttcattgtgacctactcctttcataaatgccaatctgtgagaacttttgaattttcatagcaacattgcattttggatgccatttgattgtaataaaactgtggcaccttaattttgaatggcagcatgatcatgtaatatc

SEQ ID NO: 138010 - DNA, 1757 bp, Homo sapiens
  Payload ID: 7031
  Gene Symbol: GLRB
  Gene Name: glycine receptor, beta
  Uniprot ID: P48167
  ENST ID: ENST00000509282
  CDS Start-End: 186-1679
ggggcggcggagcgcgaggagcactgcggcgtgcccgggaggacgcgcgctgccctgcgcgggagaggggcgcggggcgcctggcagcggcagccgggtccccgctgcggtggcgcccgcggagacgctccgggtggagagatgcagagggccgggatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatctcagcagtcagcagaggaccttgcccgagtacctgccaactccactagcaatatcttgaacaggttattggtcagttatgatcccaggataagaccaaacttcaaaggcattcctgttgatgtagtagtcaacatttttattaacagttttggatccattcaagaaacaacaatggactatagagttaacatcttcctgagacaaaaatggaatgaccccaggctgaagctccccagtgattttaggggttcagatgcactgacagtggatccaacaatgtacaagtgtttatggaaacctgatttattttttgcaaatgaaaaaagtgccaattttcatgatgtgacccaggaaaacatcctcctctttatttttcgtgatggagatgtccttgtcagcatgaggttatctattactctttcatgccctttggacttgacattgtttcccatggatacacaacgttgcaagatgcaactggagagctttggttacacaactgatgatttacgatttatctggcagtcaggagatcctgtgcaattagaaaaaattgccttgcctcaatttgatatcaaaaaggaagatattgaatatggtaactgtacaaaatactataaaggcacgggctactacacatgcgtggaagtcatcttcaccctgaggaggcaggtcggcttttacatgatgggggtctacgccccaactctgctcattgttgttctctcctggctttccttctggatcaacccggacgcgagtgctgccagagtgcccctgggtatcttctcagtcctcagcttggcctctgagtgcacaacccttgccgctgagcttcccaaagtttcctatgtgaaggctcttgatgtttggcttattgcttgccttctctttgggtttgcttccctggtggagtatgcagttgtccaggtgatgctgaacaaccccaaaagggttgaagctgaaaaagccagaattgctaaggctgagcaagcagatggaaaaggtggaaatgtggctaaaaagaatactgtgaatggaacagggactcctgttcatattagcactttgcaggttggtgagaccagatgcaaaaaagtttgtacttctaagtctgatctgagatctaatgacttcagcattgttggaagcttaccaagagattttgaactatccaattatgactgctatggaaaacccattgaagttaacaacggacttgggaaatctcaggctaagaacaacaagaagcctccccctgcgaaacctgttattccaacagcagcaaagcgaattgatctttatgcaagagcattgtttcctttctgcttcttgttcttcaatgttatatattggtctatatatttatgataaatcttttccatttgtacaaaataaaattccatttcattgtgacctactcctttcataaatgccaatctgtgagaa

SEQ ID NO: 138011 - DNA, 2765 bp, Homo sapiens
  Payload ID: 7031
  Gene Symbol: GLRB
  Gene Name: glycine receptor, beta
  Uniprot ID: P48167
  ENST ID: ENST00000541722
  CDS Start-End: 203-1114
acggcgcaggctccgcggcccgagcaggcgcgtcagccgagctcggcggtggcgcgggcggctgggacgcagctgcccccgctcggcgcccgctgcacccttagcagccactgccacctgggcccggagcctccacgatctcgcccggcgattgtgggcaggggcgcctccggatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatctcagcagtcagcagaggaccttgcccgagtacctgccaactccactagcaatatcttgaacaggttattggtcagttatgatcccaggataagaccaaacttcaaaggcattcctgttgatgtagtagtcaacatttttattaacagttttggatccattcaagaaacaacaatggactatagagttaacatcttcctgagacaaaaatggaatgaccccaggctgaagctccccagtgattttaggggttcagatgcactgacagtggatccaacaatgtacaagtgtttatggaaacctgatttattttttgcaaatgaaaaaagtgccaattttcatgatgtgacccaggaaaacatcctcctctttatttttcgtgatggagatgtccttgtcagcatgaggttatctattactctttcatgccctttggacttgacattgtttcccatggatacacaacgttgcaagatgcaactggagagctttggttacacaactgatgatttacgatttatctggcagtcaggagatcctgtgcaattagaaaaaattgccttgcctcaatttgatatcaaaaaggaagatattgaatatggtaactgtacaaaatactataaaggcacgggctactacacatgcgtggaagtcatcttcaccctgaggaggcaggtcggcttttacatgatgggggtctacgccccaactctgctcattgttgttctctcctggctttccttctggatcaacccggacgcgagtgctgccagagtgcccctgggttggtgagaccagatgcaaaaaagtttgtacttctaagtctgatctgagatctaatgacttcagcattgttggaagcttaccaagagattttgaactatccaattatgactgctatggaaaacccattgaagttaacaacggacttgggaaatctcaggctaagaacaacaagaagcctccccctgcgaaacctgttattccaacagcagcaaagcgaattgatctttatgcaagagcattgtttcctttctgcttcttgttcttcaatgttatatattggtctatatatttatgataaatcttttccatttgtacaaaataaaattccatttcattgtgacctactcctttcataaatgccaatctgtgagaacttttgaattttcatagcaacattgcattttggatgccatttgattgtaataaaactgtggcaccttaattttgaatggcagcatgatcatgtaatatctgtgctctaataacgatgtatatatgtatagtgaacatattgcttagtaacaaatgaaggacaagcatactacataatataatccatacaattctcttcagttagtgtaaactgcaaatactacagataattctgataataaaatgatatgcacgctgaatcctgctatggtcaccattctaatgtatgtagtatttcaaatttccttccttgtaactttcaaagaaagccatcttattcttgtaaaattttagatggtattatcacagatttaaaaaggttgtattacatattgtttaaactttgtaagtagaaatatatctgttataattatacaggctctgtggagaaataaagttcaaaatatattaatttgtaaaatcagctcgttttaaagtgtgcttgtgttgtcaaaaatatcagatagtaatacacagtgagcatttttaaacaaagggaaacctatatttatgtaactgtatactgaattctgacaaaataaaaaaagataccttattgacgaaatatttaggataaacaaaattctatttaatccaccttaaaacctaaatgtattttcatggatttcatttgttggtacatattacacaaaacattgtgccttaaaatgagtcatacatcttttaaattggaatgcagtaatagatatgtgattttacatcatttttaagaaaccaaggggaagtaataagttgaaaaagaaatccataactattaaaagattttaacttttttattttattaaaatgcttgcatattttaagtaaaattaaaaatgtttactgaatttatttttttatttgaatattttgggattagttacaaaatatttagagattaaataaataatagctttgtttgtgttagacttcacttctacttgtattttctttcttgttaaaagtctagacaactgagatttacttactttgaacttgttccaatccaaaagtaagcactaagtctcattttatgagaccaccatttcttaatatcacatccagtgcacctttgtctttctgccatatctgaaataaaactatcagtaattcacatagataaacataagactaaagaagtatatttacattatctggagagttttgttgcagctacgagtttgtatggcaaattcaataataaagtattgtttatgcaaattgc

SEQ ID NO: 138012 - DNA, 1150 bp, Homo sapiens
  Payload ID: 7032
  Gene Symbol: GLYAT
  Gene Name: glycine-N-acyltransferase
  Uniprot ID: Q6IB77
  ENST ID: ENST00000278400
  CDS Start-End: 156-647
agaaatttctggaggtggtgtatcaaaatttactctgcgagactctgctgaactggctgcatcagggagaaatttcatctcccagaagggtgttgctcatcgtttcttcccggaaacatctgcagagactagcttttcaggctaaggtatcctccatgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatccccaaaactgtcaggaattccttggatcaccagaactcatcaactggaaacagcatttacagattcaaagttcacagcctagcctgaatgaggctatacaaaatcttgcagccattaagtccttcaaagtcaaacaaacacaacgcattctctatatggcagctgaaacagccaaggaactgactcctttcctgctgaaatcaaagattttatctcccaatggtggcaaacccaaggccatgtgagtttgataaaatccagtctataccactcacacctctcaagtaacctcccaacttctctccctgcattcactctggctttcctacaatcaatgttgtacaaagaaatcagaattacatttttaaaaaatgtaactcagaacatgtttctctcctgcttaaaagactccaccatctcccttctcatctagaataaaccaggcctctggctaccacttggacctttattgcccttcctgctttcttcctccaacagctctgaccttcactctgttcctctttcatcacaagctcatctatattccaggacttcacatttgttatttcttctgtctactctgtctctcaagacaatagaggtcacagcaaatacaaacctttatactaatggattttgttttcttcttggaccctccatagcaaccaagagatgtttaaactctcatccatggatgttacccatgctcacttggtgaataaattctggcattttggtggtaatgaga

SEQ ID NO: 138013 - DNA, 1735 bp, Homo sapiens
  Payload ID: 7032
  Gene Symbol: GLYAT
  Gene Name: glycine-N-acyltransferase
  Uniprot ID: Q6IB77
  ENST ID: ENST00000344743
  CDS Start-End: 143-1033
ggtggtgtatcaaaatttactctgcgagactctgctgaactggctgcatcagggagaaatttcatctcccagaagggtgttgctcatcgtttcttcccggaaacatctgcagagactagcttttcaggctaaggtatcctccatgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatccccaaaactgtcaggaattccttggatcaccagaactcatcaactggaaacagcatttacagattcaaagttcacagcctagcctgaatgaggctatacaaaatcttgcagccattaagtccttcaaagtcaaacaaacacaacgcattctctatatggcagctgaaacagccaaggaactgactcctttcctgctgaaatcaaagattttatctcccaatggtggcaaacccaaggccatcaaccaagagatgtttaaactctcatccatggatgttacccatgctcacttggtgaataaattctggcattttggtggtaatgagaggagccagagattcattgagcgctgcattcagacctttcccacctgctgtctcctggggcctgaggggacccctgtgtgctgggatctaatggaccagactggagagatgagaatggcaggcaccttgccggaataccggctccatggccttgtgacgtatgtcatctattcccacgcccagaaattgggcaaacttgggtttcctgtctattctcatgtagactacagcaatgaagctatgcaaaaaatgagttacacactgcaacatgttcccattcccagaagctggaaccagtggaactgtgtacctctgtgatgccaatcctgaacataagacagtgttgggcaggtctgggcgtataatttgaggagtggatggtggatgaaaagaaataataaattgtaatcagcagtaaaggagtgggcactgtttggactctggggaagcagtgtgatgttcaacagcatcgccatggtccctgcattcacaggtttctcagtgggaagcaggcccaggtcctcttacatttgacataagcaatttacctccccacatttccaggacctctatgacacttcatcagatacatattgctccaaattacttctcctggaatccctggttcctcagttgcaagacccttgccagtttttctgggagctaggaagaggtgaattaaattttctgagcactatgacttctttctttctaaagcctttcccttatgatcaacaagtggactctcctcagcaggtctttagagattatcctctcctgttattgctactttataggtacattaaatatactggacacaaatatatatgggatattaggctaaatacagtatacatgatatagcagggaatgttactagaagaaatatcaactgatgatatcctatcctctccaagctcctattccaggaaaaaagatccaatgttttttctaaagatgagcttccaaaacccacaactcctaaataatacagaaagttttgtgtttgactgtatacaa

SEQ ID NO: 138014 - DNA, 1070 bp, Homo sapiens
  Payload ID: 7032
  Gene Symbol: GLYAT
  Gene Name: glycine-N-acyltransferase
  Uniprot ID: Q6IB77
  ENST ID: ENST00000529732
  CDS Start-End: 82-972
cagtgacagtccttgtgctctggttagattccatatccctgaacttcaacctgaaaacttccatcagctaaggtatcctccatgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatccccaaaactgtcaggaattccttggatcaccagaactcatcaactggaaacagcatttacagattcaaagttcacagcctagcctgaatgaggctatacaaaatcttgcagccattaagtccttcaaagtcaaacaaacacaacgcattctctatatggcagctgaaacagccaaggaactgactcctttcctgctgaaatcaaagattttatctcccaatggtggcaaacccaaggccatcaaccaagagatgtttaaactctcatccatggatgttacccatgctcacttggtgaataaattctggcattttggtggtaatgagaggagccagagattcattgagcgctgcattcagacctttcccacctgctgtctcctggggcctgaggggacccctgtgtgctgggatctaatggaccagactggagagatgagaatggcaggcaccttgccggaataccggctccatggccttgtgacgtatgtcatctattcccacgcccagaaattgggcaaacttgggtttcctgtctattctcatgtagactacagcaatgaagctatgcaaaaaatgagttacacactgcaacatgttcccattcccagaagctggaaccagtggaactgtgtacctctgtgatgccaatcctgaacataagacagtgttgggcaggtctgggcgtataatttgaggagtggatggtggatgaaaagaaataataaattgtaatcagcagt

SEQ ID NO: 138015 - DNA, 482 bp, Homo sapiens
  Payload ID: 7032
  Gene Symbol: GLYAT
  Gene Name: glycine-N-acyltransferase
  ENST ID: ENST00000586098
  CDS Start-End: 1-215
accaaatctactccaaagatccccaaaactgtcaggaattccttggatcaccagaactcatcaactggaaacagcatttacagattcaaagcttaattgggagccaatgctataaacaacgagccactgcaggtttttgtctcagagtttgccatgatcccagctgtccttcaggagatgggaatacttgttggaaggttgcagaaattacctagagaacatataacgatggaagtcacacttcttttctaaggtcacatgaggacttggcatctgactctgaagactgtcttgcctgcatcgtccttacactgcctctgaacaattgggggatgtgagtactgggcaccaaatgatgcctcctaatctcccagctcagcaaatgctgcccagggctgaaaacaaaacatcctcagagagttttccttgccctcctcctgttggtatcttgtccttgtcagcaaatgattcaccaccattca

SEQ ID NO: 138016 - DNA, 1899 bp, Homo sapiens
  Payload ID: 7032
  Gene Symbol: GLYAT
  Gene Name: glycine-N-acyltransferase
  Uniprot ID: Q6IB77
  ENST ID: ENST00000611865
  CDS Start-End: 1-891
atgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatccccaaaactgtcaggaattccttggatcaccagaactcatcaactggaaacagcatttacagattcaaagttcacagcctagcctgaatgaggctatacaaaatcttgcagccattaagtccttcaaagtcaaacaaacacaacgcattctctatatggcagctgaaacagccaaggaactgactcctttcctgctgaaatcaaagattttatctcccaatggtggcaaacccaaggccatcaaccaagagatgtttaaactctcatccatggatgttacccatgctcacttggtgaataaattctggcattttggtggtaatgagaggagccagagattcattgagcgctgcattcagacctttcccacctgctgtctcctggggcctgaggggacccctgtgtgctgggatctaatggaccagactggagagatgagaatggcaggcaccttgccggaataccggctccatggccttgtgacgtatgtcatctattcccacgcccagaaattgggcaaacttgggtttcctgtctattctcatgtagactacagcaatgaagctatgcaaaaaatgagttacacactgcaacatgttcccattcccagaagctggaaccagtggaactgtgtacctctgtgatgccaatcctgaacataagacagtgttgggcaggtctgggcgtataatttgaggagtggatggtggatgaaaagaaataataaattgtaatcagcagtaaaggagtgggcactgtttggactctggggaagcagtgtgatgttcaacagcatcgccatggtccctgcattcacaggtttctcagtgggaagcaggcccaggtcctcttacatttgacataagcaatttacctccccacatttccaggacctctatgacacttcatcagatacatattgctccaaattacttctcctggaatccctggttcctcagttgcaagacccttgccagtttttctgggagctaggaagaggtgaattaaattttctgagcactatgacttctttctttctaaagcctttcccttatgatcaacaagtggactctcctcagcaggtctttagagattatcctctcctgttattgctactttataggtacattaaatatactggacacaaatatatatgggatattaggctaaatacagtatacatgatatagcagggaatgttactagaagaaatatcaactgatgatatcctatcctctccaagctcctattccaggaaaaaagatccaatgttttttctaaagatgagcttccaaaacccacaactcctaaataatacagaaagttttgtgtttgactgtatacaatttttattgtgtttgttcaagctaagtggttcatcatggtgacagcatgaaaggaatgagtgtatgaaaaggtgaaggtgggagcaccttgacccagggatgtgatggtttattgaggagagataggagttgaagggagaggagacagcatgaacacctgcttgtccaattagcctcagcacattactaatctcagtttgttcctgctgtaacaaaatacctgagactgggtaattcataaataacagtctgaacttatttgtttatttaaaataataataaaataattaaaaatttatttatcac

SEQ ID NO: 138017 - DNA, 2068 bp, Homo sapiens
  Payload ID: 7033
  Gene Symbol: GLYATL1
  Gene Name: glycine-N-acyltransferase-like 1
  Uniprot ID: Q969I3
  ENST ID: ENST00000300079
  CDS Start-End: 51-1052
agtgttggccaatcccagcagccatacttcaactactcatagactgctgaatgttcaaactgtgttcaaataagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaacctaatctgtatggatactttatcaaaaatgaatgtccctgctatttctggatttatgaggcaatggtacactaaagaatggaatcagttcagtgagtagaaaggtatccaaggtgaagcctgagacgaatggctttcccaggctaccttccatcactgttgtacagaaaagaaatccagagaatcaaatggactggccttgggggtctctgctatggaaatgccattttttgtgtctcctttctcctactctttctcacatcctcttcatgattgaagcatggcacaaggcaaggtgttgcctgcgagtctggttgtaagttcagcctttggtgtttgcactactgctatcataaggggtcagggacattccggggagaagtgaccactaaggtgaggattagagagtgagtagaagtgagccagacaaaaaaagcagaaaatgcagatgatggaaaggacatgtgccatgcactatcataagaacttcctaactgaacactgatactacaattctgaatccctgatcttaaaaaataattatacttcaccaacaaaacttggcctcttttggttccactctgccaccctgccattggaacttggattactgtgaacattgcagctatagcaaaat

SEQ ID NO: 138018 - DNA, 1627 bp, Homo sapiens
  Payload ID: 7033
  Gene Symbol: GLYATL1
  Gene Name: glycine-N-acyltransferase-like 1
  Uniprot ID: Q969I3
  ENST ID: ENST00000317391
  CDS Start-End: 341-1249
gatcgctttgccaattttgcgttactgggcaggctaagagatcttcttttaattcagcctgcttaagacgggaactgataactgtagtgtatcctctgccttttttcttatctattggaggaagctcaggtgaagaaatggagttgccatcaactaagttgagaaagactacagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataa

SEQ ID NO: 138019 - DNA, 584 bp, Homo sapiens
  Payload ID: 7033
  Gene Symbol: GLYATL1
  Gene Name: glycine-N-acyltransferase-like 1
  ENST ID: ENST00000534612
  CDS Start-End: 249-401
agtaacagcttttggtttcccgaccaggaacactttggctcagttgccatgggccaggagtctcacagaactactaagcagctgcttacccaattttggctggagagataagtaccctctggggccaccacagctggccccaaccatggtcctgattgccttggaagaactgcctttggaatttcacatcggcatccagataggtgaagaaatggagttgccatcaactaagttgagaaagactacagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattat

SEQ ID NO: 138020 - DNA, 728 bp, Homo sapiens
  Payload ID: 7033
  Gene Symbol: GLYATL1
  Gene Name: glycine-N-acyltransferase-like 1
  ENST ID: ENST00000524881
  CDS Start-End: 91-243
ggttcctgtacatcactttaccttttttgtctataaattcattttgaccacgaggcacccccggagcctcggtgaatctgctgtgattttatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacc

SEQ ID NO: 138021 - DNA, 573 bp, Homo sapiens
  Payload ID: 7033
  Gene Symbol: GLYATL1
  Gene Name: glycine-N-acyltransferase-like 1
  ENST ID: ENST00000525608
  CDS Start-End: 368-573
agttttttctcactgcttgcttggcaatgcagctctagcttctaatgcccttttttaaccctttaggtatctgatcgctttgccaattttgcgttactgggcaggctaagagatcttcttttaattcagcctgcttaagacgggaactgataactgtagtgtatcctctgccttttttcttatctattggaggaagctcagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcaggagatgactgatgacatgga

SEQ ID NO: 138022 - DNA, 760 bp, Homo sapiens
  Payload ID: 7033
  Gene Symbol: GLYATL1
  Gene Name: glycine-N-acyltransferase-like 1
  ENST ID: ENST00000526351
  CDS Start-End: 241-760
ttctcactgcttgcttggcaatgcagctctagcttctaatgcccttttttaaccctttaggtatctgatcgctttgccaattttgcgttactgggcaggctaagagatcttcttttaattcagcctgcttaagacgggaactgataactgtagtgtatcctctgccttttttcttatctattggaggaagctcaggtgaagaaatggagttgccatcaactaagttgagaaagactacagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaa

SEQ ID NO: 138023 - DNA, 647 bp, Homo sapiens
  Payload ID: 7033
  Gene Symbol: GLYATL1
  Gene Name: glycine-N-acyltransferase-like 1
  ENST ID: ENST00000530774
  CDS Start-End: 40-261
atcccagcagccatacttcaactactcatagactgctgaatgttcaaactgtgttcaaataagatggtgtcacaagaaggatctgaagtggagcttctagtatccccaggagcgcgaagtgaacacggaaggtacctgcaggatccaattgtgtccattgatctctcagagtggctgaggataataggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctg

SEQ ID NO: 138024 - DNA, 1528 bp, Homo sapiens
  Payload ID: 7033
  Gene Symbol: GLYATL1
  Gene Name: glycine-N-acyltransferase-like 1
  ENST ID: ENST00000527708
  CDS Start-End: 51-227
agtgttggccaatcccagcagccatacttcaactactcatagactgctgaatgttcaaactgtgttcaaataagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaa

SEQ ID NO: 138025 - DNA, 571 bp, Homo sapiens
  Payload ID: 7033
  Gene Symbol: GLYATL1
  Gene Name: glycine-N-acyltransferase-like 1
  ENST ID: ENST00000532726
  CDS Start-End: 334-571
ggctcagttgccatgggccaggagtctcacagaactactaagcagctgcttacccaattttggctggagagataagtaccctctggggccaccacagctggccccaaccatggtcctgattgccttggaagaactgcctttggaatttcacatcggcatccagatagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctcca

SEQ ID NO: 138026 - DNA, 1709 bp, Homo sapiens
  Payload ID: 7033
  Gene Symbol: GLYATL1
  Gene Name: glycine-N-acyltransferase-like 1
  ENST ID: ENST00000530240
  CDS Start-End: 232-384
gttcaaataaggcaagcgcccagttgtaaccaatctctttgtttctgtacctgatttctggttcctgtacatcactttaccttttttgtctataaattcattttgaccacgaggcacccccggagcctcggtgaatctgctgtgattttgtaggctgccggattcacaaattgtttgttgcttaatgaaactcctttaagtttaattcagctgaagtttttcttttatcagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaacctaatctgtatggatactttatc

SEQ ID NO: 138027 - DNA, 909 bp, Homo sapiens
  Payload ID: 7033
  Gene Symbol: GLYATL1
  Gene Name: glycine-N-acyltransferase-like 1
  Uniprot ID: Q969I3
  ENST ID: ENST00000612196
  CDS Start-End: 1-909
atgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttag

SEQ ID NO: 138028 - DNA, 909 bp, Homo sapiens
  Payload ID: 7034
  Gene Symbol: GLYATL1P3
  Gene Name: glycine-N-acyltransferase-like 1 pseudogene 3
  ENST ID: ENST00000527482
  CDS Start-End: 1-909
atgattctattgaataattccgagcggctgctggccctattcaaatctttagcaaggagcattcctgagtccctgaaggtgtatggctctctgtttcacatcaatcacgggaaccccttcaacatggaagtgttggtggactcctggcccgagtatcagatggttattatccgacctcaaaaacaggagatgactgatgacatggattcatacactaatgtatatcgtgtattctccaaagaccctcaaaaatcacaagaagttttgaaaaattctgagatcataaactggaaacagaaactccaaatccaaggttttcaagaaagtttaggtgaggggataagagcagctgcattttcaaattcagtgaaggtagagcattcgagagcactcctctttgttacggaagatatcctgaagctctatgccaccaataaaagcaagcttggaagctgggctgagacaggccacccagatgacgaattggagagcgagactccgaactttaagtatgcccagctgaatgtgtcttattctgggctggtaaatgacaactggaagctagggatgaataagaggagcctgcgttacatcaagcgctgcctaggagccctgccagcagcctgtatgctgggcccagagggggtcccggtctcatgggtaaccatggacccttcttgtgaaataggaatgggctacagtgtggaaaaataccgaaggagaggcaatgggacacggctgatcatgcgatgcatgaagtatctgtgtcagaagaatattccattttacggctctgtgctggaagaaaatcaaggcgtcatcagaaagactagtgcactaggtttccttgaggcctcctgtcagtggcaccaatggaactgctacccacagaatcttgttccattgtag

SEQ ID NO: 138029 - DNA, 1640 bp, Homo sapiens
  Payload ID: 7035
  Gene Symbol: GLYATL2
  Gene Name: glycine-N-acyltransferase-like 2
  Uniprot ID: Q8WU03
  ENST ID: ENST00000287275
  CDS Start-End: 392-1276
aattgacttaatattgttctagaatagcctttcagctacaagaggttatatataaatcaaaagcttcttgagtaaaacttcttagaattgtagaagctgctcaatatggaacatattctcagtcctcctctggtctacaaagcctgtgatttcttgtctatggacagaacgtctggtttaatctacaggaacccataacttcctgaagctttatgcttaacagtgacaacgtgagtcagttgaattttattgtgtttcagtccgtagagtattagctacagaaacctttccattgccatactgagaaactgcagcaggcagtgtgcctacaggtctacaaagaaacttcagatcatcttcttgagggaaagaagctgaagtgctacataagatgcttgtgcttcataactctcagaagctgcagattctgtataaatccttagaaaagagcatccctgaatccataaaggtatatggcgccattttcaacataaaagataaaaaccctttcaacatggaggtgctggtagatgcctggccagattaccagatcgtcattacccggcctcagaaacaggagatgaaagatgaccaggatcattataccaacacttaccacatcttcaccaaagctcctgacaaattagaggaagtcctgtcatactccaatgtaatcagctgggagcaaactttgcagatccaaggttgccaagagggcttggatgaagcaataagaaaggttgcaacttcaaaatcagtgcaggtagattacatgaaaaccatcctctttataccggaattaccaaagaaacacaagacctcaagtaatgacaagatggagttatttgaagtggatgatgataacaaggaaggaaacttttcaaacatgttcttagatgcttcacatgcaggtcttgtgaatgaacactgggcctttgggaaaaatgagaggagcttgaaatatattgaacgctgcctccaggattttctaggatttggtgtgctgggtccagagggccagcttgtctcttggattgtgatggaacagtcctgtgagttgagaatgggttatactgtccccaaatacagacaccaaggcaacatgttgcaaattggttatcatcttgaaaagtatctttctcagaaagaaatcccattttatttccatgtggcagataataatgagaaaagcctacaggcactgaacaatttggggtttaagatttgtccttgtggctggcatcagtggaaatgcacccccaagaaatattgttgattgattccactgtccatttcaaatctttcttatcagtaaaaaaacattaattcaaacacaagcattgtgatctacattagcacaaaatgcaactgattatctaggatctgtgtattacttaagctcacccttaacagttttaccttccttctcctctgtattcttacagaaaattagaagctcaattttatggtctcataatttcctttatgacagacatctcagaattaaaatcacccaaagccaatcattagtgccaagataaccctttaacggcaacactttcttaaatgaagactatttctttcatgaaaaaattcacttttatgactttcttgttaaaataaaaagtctgcttttaaaa

SEQ ID NO: 138030 - DNA, 1488 bp, Homo sapiens
  Payload ID: 7035
  Gene Symbol: GLYATL2
  Gene Name: glycine-N-acyltransferase-like 2
  Uniprot ID: Q8WU03
  ENST ID: ENST00000532258
  CDS Start-End: 272-1156
agtccgtagagtattagctacagaaacctttccattgccatactgagaaactgcagcaggcagtgtgcctacaggtctacaaagaaacttcagagtctcacactgtcacccaggctggaatgcagtggtgcgatatcagatcactgcaacctcctcttccttggttcaagcaattctcctgcctcagcctcctgagtagctgggactactgacactcaccaccacacccagatcatcttcttgagggaaagaagctgaagtgctacataagatgcttgtgcttcataactctcagaagctgcagattctgtataaatccttagaaaagagcatccctgaatccataaaggtatatggcgccattttcaacataaaagataaaaaccctttcaacatggaggtgctggtagatgcctggccagattaccagatcgtcattacccggcctcagaaacaggagatgaaagatgaccaggatcattataccaacacttaccacatcttcaccaaagctcctgacaaattagaggaagtcctgtcatactccaatgtaatcagctgggagcaaactttgcagatccaaggttgccaagagggcttggatgaagcaataagaaaggttgcaacttcaaaatcagtgcaggtagattacatgaaaaccatcctctttataccggaattaccaaagaaacacaagacctcaagtaatgacaagatggagttatttgaagtggatgatgataacaaggaaggaaacttttcaaacatgttcttagatgcttcacatgcaggtcttgtgaatgaacactgggcctttgggaaaaatgagaggagcttgaaatatattgaacgctgcctccaggattttctaggatttggtgtgctgggtccagagggccagcttgtctcttggattgtgatggaacagtcctgtgagttgagaatgggttatactgtccccaaatacagacaccaaggcaacatgttgcaaattggttatcatcttgaaaagtatctttctcagaaagaaatcccattttatttccatgtggcagataataatgagaaaagcctacaggcactgaacaatttggggtttaagatttgtccttgtggctggcatcagtggaaatgcacccccaagaaatattgttgattgattccactgtccatttcaaatctttcttatcagtaaaaaaacattaattcaaacacaagcattgtgatctacattagcacaaaatgcaactgattatctaggatctgtgtattacttaagctcacccttaacagttttaccttccttctcctctgtattcttacagaaaattagaagctcaattttatggtctcataatttcctttatgacagacatctcagaattaaaatcacccaaagccaatcattagtgccaagataaccctttaacggcaacactttcttaaatgaagactatttctttcatgaaaaaattcacttttatgact

SEQ ID NO: 138031 - DNA, 1113 bp, Homo sapiens
  Payload ID: 7036
  Gene Symbol: GLYATL3
  Gene Name: glycine-N-acyltransferase-like 3
  Uniprot ID: Q5SZD4
  ENST ID: ENST00000371197
  CDS Start-End: 114-980
aagaataaacttaccatttatataaaagggctactggactgatacacagctgaaaaccctcagttctggactgaactcccagcaggtgtggagttgcaagagctctggaaaagatgttggtgctaaactgttctaccaaattactgatactggagaaaatgttgaagagttgctttcctgaatcactcaaggtttacggagcggtgatgaacataaatcgtgggaacccctttcaaaaggaagtggtgttggattcatggccggatttcaaagctgttatcacccgacgacaaagagaggctgagacagataaccttgatcattatactaatgcctatgctgtgttctacaaggatgtcagggcttatcgacagctattggaagaatgtgatgtttttaactgggaccaagtttttcaaatacaagggctgcagagtgagttatatgatgtttccaaagcggttgccaattcaaagcagttgaatataaagctaacttccttcaaggctgttcatttttctcctgtttcatctctgccagataccagtttcctcaaggggccttccccacgactaacctacctgagtgttgccaatgcggatctactcaaccggacttggtcccggggaggcaatgaacaatgtctccggtacatcgccaacctcatctcctgcttccctagtgtgtgtgtccgggatgagaagggaaacccggtctcctggtccatcacagaccagtttgccaccatgtgccatggctacaccctgccagaacatcgcaggaaaggttacagccggctggtggccctcacgctggccaggaagttgcaaagccggggattcccctctcaggggaacgtcctggatgacaacacggcgtctataagcctcctgaagagtctccatgctgagttcttgccttgtcgcttccacaggcttattctcacccctgcgactttctctggcctgcctcacctctagcccagtaaaaaactgcagtggttttattactttccctgagcatacacacactcttggctgccaacgaggggagagttaaaatgggaatcaggggactcttgagttgttggaaagggtctggagaatatataca

SEQ ID NO: 138032 - DNA, 571 bp, Homo sapiens
  Payload ID: 7036
  Gene Symbol: GLYATL3
  Gene Name: glycine-N-acyltransferase-like 3
  ENST ID: ENST00000545705
  CDS Start-End: 104-571
ataaaagggctactggactgatacacagctgaaaaccctcagttctggactgaactcccagcagtttctaattaggtgtggagttgcaagagctctggaaaagatgttggtgctaaactgttctaccaaattactgatactggagaaaatgttgaagagttgctttcctgaatcactcaaggtttacggagcggtgatgaacataaatcgtgggaacccctttcaaaaggaagtggtgttggattcatggccggatttcaaagctgttatcacccgacgacaaagagaggctgagacagataaccttgatcattatactaatgcctatgctgtgttctacaaggatgtcagggcttatcgacagctattggaagaatgtgatgtttttaactgggaccaagtttttcaaatacaagggctgcagagtgagttatatgatgtttccaaagcggttgccaattcaaagcagttgaatataaagctaacttccttcaaggctgttcatttttctcctgtttcatctctgccagataccagtttcctcaaggggccttccccacgactaacctac

SEQ ID NO: 138033 - DNA, 3378 bp, Homo sapiens
  Payload ID: 7037
  Gene Symbol: GYS1
  Gene Name: glycogen synthase 1 (muscle)
  Uniprot ID: P13807
  ENST ID: ENST00000263276
  CDS Start-End: 199-2220
cagtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaa

SEQ ID NO: 138034 - DNA, 3574 bp, Homo sapiens
  Payload ID: 7037
  Gene Symbol: GYS1
  Gene Name: glycogen synthase 1 (muscle)
  Uniprot ID: P13807
  ENST ID: ENST00000323798
  CDS Start-End: 198-2411
agtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatccca

SEQ ID NO: 138035 - DNA, 427 bp, Homo sapiens
  Payload ID: 7037
  Gene Symbol: GYS1
  Gene Name: glycogen synthase 1 (muscle)
  ENST ID: ENST00000594220
  CDS Start-End: 1-341
gtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccgggtaggacccccactttcctatcctctcctggcaaatcagcagctcctggctaggggtctttggtgcagggtgcagggtctcatcctacttgtaacagttgctgtccctttaagcaatgaaccaggccgatcgcgatggtggctcatggttgtaatcccagcactttgggaggcctaacaggaaggatcgcatgagctcaggagttaagagaccagcctgggcaacattttatttttactaaaaataaaaaaaaatcagccgag

SEQ ID NO: 138036 - DNA, 3132 bp, Homo sapiens
  Payload ID: 7038
  Gene Symbol: GYS2
  Gene Name: glycogen synthase 2 (liver)
  Uniprot ID: P54840
  ENST ID: ENST00000261195
  CDS Start-End: 256-2367
agatactgacagggcagataccgtcctcacaatacctgcccagaaagacgagaaagaggaggaagaattcctccttccaccaggaattctgtgggaagcacataagatttcatgctactagtttattcccaagagaagctaccaaagcctggtaactctaccaactctaacttttgtgcctgtaagttctcttctcctgggattacaactaattgaaacaggaattcaaaggagtctcggaggactgtaagaagaatgcttcgaggccgatccctctctgtaacatccctgggtgggcttccccagtgggaagtcgaagaacttcctgtggaggagttactgctctttgaagttgcttgggaagtgaccaataaagttggaggcatctatactgtgattcagacaaaggccaaaacaacagcagatgaatggggagagaactattttctgataggtccatattttgagcataatatgaagactcaggtggaacagtgtgaacctgtaaatgatgctgtcagaagagcagtggacgcaatgaataagcatggctgccaggtgcattttggaagatggctgatagaaggaagtccttatgtggtactttttgacataggctattcagcttggaatctggacaggtggaagggtgacctctgggaagcatgcagtgtcggcattccttatcatgaccgagaagccaatgatatgctgatatttggatctttaactgcctggttcttaaaagaggtgacagatcatgcagatggtaaatatgtcgttgcccaattccatgaatggcaggctggaattggactgatcctttctcgagccaggaaacttcctattgccacaatatttacaacccacgctacactacttgggaggtatctctgtgcagcaaatattgatttctacaaccatcttgataagtttaacattgacaaagaggctggggaaaggcagatttaccaccggtactgcatggagcgagcttccgttcattgcgctcacgtgttcaccacggtttctgaaataacagcaatagaagctgaacatatgctgaagagaaagcctgatgtagttactccaaacggcttgaatgttaagaaattttcagcagtgcatgagtttcaaaatctacatgccatgtacaaggccagaatccaagattttgttcgaggtcatttctatggtcatctcgactttgatcttgaaaagactttgttccttttcattgctgggaggtatgagttttcaaacaaaggagctgacatcttcctagaatccttatccaggctaaatttcctgctgaggatgcataaaagtgacatcacagtgatggtgtttttcattatgcctgccaagacaaataatttcaacgtggaaaccctgaaaggacaagcagtgcgaaaacagctgtgggatgttgcacattctgtgaaggaaaagtttggaaaaaaactctatgatgcattattaagaggagaaattcctgacctgaacgatattttagatcgagatgatctaacaattatgaaaagagccatcttttcaactcagcgacagtcattgcccccagtgaccacgcacaacatgattgatgactccaccgaccccatcctcagcaccattagacggattggacttttcaacaaccgcacagatagagtcaaggtgattttgcacccagagtttctatcctccaccagtcccttactacccatggactatgaagagtttgttagaggttgtcatcttggagtatttccatcatactatgaaccctggggttatactccagctgaatgcactgtgatgggtatccccagtgtgaccacgaatctctccgggtttggctgtttcatgcaggagcacgtggctgatcctactgcttacggtatttacatcgttgacaggcggttccgttctccagatgattcttgcaatcagctgactaagtttctctatggattttgcaaacagtcacgccgccaaaggattatccagaggaacagaactgagaggctctcagatcttctggattggagatacttaggcagatattaccagcatgccagacacctgacattaagcagagcttttccagataaattccatgtggaactaacatcaccaccaacgacagaaggatttaaatatcccaggccttcctcagtaccaccttctccttcagggtctcaggcctccagtcctcagagcagtgatgtggaagatgaagtggaggatgagagatacgatgaggaagaggaggctgaaagggatcggttaaatatcaagtcaccattttcactgagccacgttcctcatgggaagaaaaagctgcatggtgaatataagaactgaattctacatgtgctgcatgaagagctaatttaaaaaagcaaagtaagactaattatttaaaataaaaatgccacaaatttcattttctccttctaagtattacaatggagtttattctctgcctaaaaagtggaagaaattgagtgaatgacaattttgtaatttaggataagatccaagttattttccccaactcttgtttcccccataaagttaggcatgaggaggagcactcattaaaggcagaagacggaaaagtgtttttaaaatggtgaatttaagtggtaaggattttctcttactctgtttatttttaaatgatcatcataatcctttgcttactatttatgcagcttctctaccccaccacacaaatttcccatttcccccccgaaaaccttgatcttacccatgaatgtgcactacctacattttttaaatagctaggtttttactgattattttcatttttcacatgcatcagaaccatgatttagatgtagttttgcagagacaaaaatccatgagtgaatagctatcctaagtccatattttgatgcatattaatggacatttatgtcacttttgaaatctagaattgatgttgtaattaatgcaagatattaccatgtacatggtaccaccatcttactgtaacatttttctattgtttaaatagaaagcctttttaaaatttggtcaatcttcatagatgataacttgtaaaatccaagtaaataaacacattaatatttaataacttaa

SEQ ID NO: 138037 - DNA, 2188 bp, Homo sapiens
  Payload ID: 7039
  Gene Symbol: GSK3A
  Gene Name: glycogen synthase kinase 3 alpha
  Uniprot ID: P49840
  ENST ID: ENST00000222330
  CDS Start-End: 129-1580
gagccggagcccaagccagagcggcgcggcctggaagaggccagggcccgggggaggcggcggcagcggcggcggctggggcagcccgggcagcccgagccccgcagcctgggcctgtgctcggcgccatgagcggcggcgggccttcgggaggcggccctgggggctcgggcagggcgcggactagctcgttcgcggagcccggcggcggaggcggaggaggcggcggcggccccggaggctcggcctccggcccaggcggcaccggcggcggaaaggcatctgtcggggccatgggtgggggcgtcggggcctcgagctccgggggtggacccggcggcagcggcggaggaggcagcggaggccccggcgcaggcactagcttcccgccgcccggggtgaagctgggccgtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattctcatccctcctcacttgaggtccccagcgggcactaccaccctcaccccgtcctcacaagctttaactgagactccgaccagctcagactggcagtcgaccgatgccacacctaccctcactaactcctcctgagggccccaccaagcacccttccacttccatctgggagccccaagaggggctgggaaggggggccatagcccatcaagctcctgccctggctgggcccctagactagagggcagaggtaaatgagtccctgtccccacctccagtccctccctcaccagcctcacccctgtggtgggctttttaagaggattttaactggttgtggggagggaagagaaggacagggtgttggggggatgaggacctcctacccccttggccccctcccctcccccagacctccacctcctccagaccccctcccctcctgtgtcccttgtaaatagaaccagcccagcccgtctcctcttcccttccctggcccccgggtgtaaatagattgttataatttttttcttaaagaaaacgtcgattcgcaccgtccaacctggccccgcccctcctacagctgtaactcccctcctgtcctctgcccccaaggtctactccctcctcaccccaccctggagggccaggggagtggagagagctcctgatgtcttagtttccacagtaaggtttgcctgtgtacagacctccgttcaataaattattggcatgaaaacctg

SEQ ID NO: 138038 - DNA, 3524 bp, Homo sapiens
  Payload ID: 7039
  Gene Symbol: GSK3A
  Gene Name: glycogen synthase kinase 3 alpha
  ENST ID: ENST00000398249
  CDS Start-End: 1715-2920
atgttgctattcattataatattggatcagaggtcacagtcgcttgcaaatggggatctagggttattgtctcctaagagaacaagaataagaccaaccccgaaaaagagggatctgcattccctgtccttcagaagatggggatttggagcgaatatcacttagaagcagggctttgaggttactgtgttttgtccccaaagaatagggccaggctttccaaacctggtactcagatcatcttccctattaaaaccaagacctggcatcattacccaccctaaatcttgttgagctgtactgccaatggtgagaattaatagttactgccttttagatataaagacattgggagtcagcatatccttcaaaccaagtccatagtccatgttttaaaatacatggcttggtgtgtctcctttaacaaaaatggaatggagcagggtaggtcacagtttcctacagaatatggatctaaggttatacttttttaataattgttctaaggtatggtgtcattggctctgaaaaaaaaaagtgatgtagggttatctccctctgaaagaacttgtcactggcccctcaaaatggatttggtggccgggcgcggtggctcacgcctgtaatcccagcactttgggaggctgaggtgggcggatcacctgcggtcaggagttcgagaccagcctggccaactggtggaaccctgtctctactaaaaatataaaaaattagctgggcgtggtggcgggcgcctgtaatcccagcttctcgggaggctgaggcaggagaatcgcttgaacccagcaggcggaggttgcagtgagtcgagatcgtgccactgcactccagctgggcaacgagagcgaaactgtgtctcaaaaaaaaaaacaaaaaaatggatttggttcatcagttactcaaaggggtcactatcctctaagaatggcaccaaggtttgccaccatttgaataatgggaattgggaattatagctttccttcaaaggactgaggctggaatagctccttgataataaaggtcaggttcatcattatcataatttggtgcttgtccattagggaccacccacatatagtgaggggtctgggtctctggaccactcagatgaagaggtcaggtcagtgtttttttctaacctcaaagtaccaaaaagtgagggtcagggcactggcacttatagcaggagaggacattcatttctgtcaccaagaaccagtaaagttaccagctctacaggggaggacttagaggtcagtatcctctaggctgtgagagaggttagtgctttcctaaagtaggagtacctcagggttactgctccctgaagtggaagaggctcggtcaagctttctccaaataggaggggccagagggcagtagatccagagtagatggagtcaacatctgatgtctcccagtaccaagatggaccagtgatctgttgcttcctagaagtagaaatttggggttgccaacccttgaagcagagagatttaggtatcaatatcctcctatgtggaggggagcaggacttaagattcccagaaaggaagaggggaaaagtcactgggaaggtcccagcatccacctttcctcaaagaggaggaggggacaaagaggtccccaacgagcttcctgcagagatttcccttcctcccacagccccaggatagggtgatgcgcaggcaggatgggtcagtggatcgtgtatcccctttgttccccaggtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattctcatccctcctcacttgaggtccccagcgggcactaccaccctcaccccgtcctcacaagctttaactgagactccgaccagctcagactggcagtcgaccgatgccacacctaccctcactaactcctcctgagggccccaccaagcacccttccacttccatctgggagccccaagaggggctgggaaggggggccatagcccatcaagctcctgccctggctgggcccctagactagagggcagaggtaaatgagtccctgtccccacctccagtccctccctcaccagcctcacccctgtggtgggctttttaagaggattttaactggttgtggggagggaagagaaggacagggtgttggggggatgaggacctcctacccccttggccccctcccctcccccagacctccacctcctccagaccccctcccctcctgtgtcccttgtaaatagaaccagcccagcccgtctcctcttcccttccctggcccccgggtgtaaatagattgttataatttttttcttaaagaaaacgtcgattcgcaccgtccaacctggccccgcccctcctacagctgtaactcccctcctgtcctctgcccccaaggtctactccctcctcaccccaccctggagggccaggggagtggagagagctcctgatgtcttagtttccacagtaaggtttgcctgtgtacagacctccgttcaataaattattggcatgaaaa

SEQ ID NO: 138039 - DNA, 1897 bp, Homo sapiens
  Payload ID: 7039
  Gene Symbol: GSK3A
  Gene Name: glycogen synthase kinase 3 alpha
  Uniprot ID: P49840
  ENST ID: ENST00000453535
  CDS Start-End: 161-1612
tcccggcgtgccccgcggcgggcgctgggccggagccggagcccaagccagagcggcgcggcctggaagaggccagggcccgggggaggcggcggcagcggcggcggctggggcagcccgggcagcccgagccccgcagcctgggcctgtgctcggcgccatgagcggcggcgggccttcgggaggcggccctgggggctcgggcagggcgcggactagctcgttcgcggagcccggcggcggaggcggaggaggcggcggcggccccggaggctcggcctccggcccaggcggcaccggcggcggaaaggcatctgtcggggccatgggtgggggcgtcggggcctcgagctccgggggtggacccggcggcagcggcggaggaggcagcggaggccccggcgcaggcactagcttcccgccgcccggggtgaagctgggccgtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattctcatccctcctcacttgaggtccccagcgggcactaccaccctcaccccgtcctcacaagctttaactgagactccgaccagctcagactggcagtcgaccgatgccacacctaccctcactaactcctcctgagggccccaccaagcacccttccacttccatctgggagccccaagaggggctgggaaggggggccatagcccatcaagctcctgccctggctgggcccctagactagagggcagagaaaacgtcgattcgcaccgtccaacctggccccgcccctcctacagctgtaactcccctcctgtcctctgcccccaaggtctactccctcctcaccccaccctggagggccaggggagtggagagagctcctgatgtcttagtttccacagtaaggtttgcctgtgtaca

SEQ ID NO: 138040 - DNA, 7711 bp, Homo sapiens
  Payload ID: 7040
  Gene Symbol: GSK3B
  Gene Name: glycogen synthase kinase 3 beta
  Uniprot ID: P49841
  ENST ID: ENST00000264235
  CDS Start-End: 984-2246
cgggcttgtgccgccgccgccgccgccgccgcccgggccaagtgacaaaggaaggaaggaagcgaggaggagccggccccgcagccgctgacagggctctgggctggggcaaagcgcggacacttcctgagcgggcaccgagcagagccgaggggcgggagggcggccgagctgttgccgcggacgggggagggggccccgagggacggaagcggttgccgggttcccatgtccccggcgaatggggaacagtcgaggagccgctgcctggggtctgaagggagctgcctccgccaccgccatggccgctggatccagccgccgcctgcagctgctcctggcgcaatgaggagaggagccgccgccaccgccaccgcccgcctctgactgactcgcgactccgccgccctctagttcgccgggcccctgccgtcagcccgccggatcccgcggcttgccggagctgcagcgtttcccgtcgcatctccgagccaccccctccctccctctccctccctcctacccatccccctttctcttcaagcgtgagactcgtgatccttccgccgcttcccttcttcattgactcggaaaaaaaatccccgaggaaaatataatattcgaagtactcattttcaatcaagtatttgcccccgtttcacgtgatacatatttttttaggatttgccctctcttttctctcctcccaggaaagggaggggaaagaattgtattttttcccaagtcctaaatcatctatatgttaaatatccgtgccgatctgtcttgaaggagaaatatatcgcttgttttgttttttatagtatacaaaaggagtgaaaagccaagaggacgaagtctttttctttttcttctgtgggagaacttaatgctgcatttatcgttaacctaacaccccaacataaagacaaaaggaagaaaaggaggaaggaaggaaaaggtgattcgcgaagagagtgatcatgtcagggcggcccagaaccacctcctttgcggagagctgcaagccggtgcagcagccttcagcttttggcagcatgaaagttagcagagacaaggacggcagcaaggtgacaacagtggtggcaactcctgggcagggtccagacaggccacaagaagtcagctatacagacactaaagtgattggaaatggatcatttggtgtggtatatcaagccaaactttgtgattcaggagaactggtcgccatcaagaaagtattgcaggacaagagatttaagaatcgagagctccagatcatgagaaagctagatcactgtaacatagtccgattgcgttatttcttctactccagtggtgagaagaaagatgaggtctatcttaatctggtgctggactatgttccggaaacagtatacagagttgccagacactatagtcgagccaaacagacgctccctgtgatttatgtcaagttgtatatgtatcagctgttccgaagtttagcctatatccattcctttggaatctgccatcgggatattaaaccgcagaacctcttgttggatcctgatactgctgtattaaaactctgtgactttggaagtgcaaagcagctggtccgaggagaacccaatgtttcgtatatctgttctcggtactatagggcaccagagttgatctttggagccactgattatacctctagtatagatgtatggtctgctggctgtgtgttggctgagctgttactaggacaaccaatatttccaggggatagtggtgtggatcagttggtagaaataatcaaggtcctgggaactccaacaagggagcaaatcagagaaatgaacccaaactacacagaatttaaattccctcaaattaaggcacatccttggactaaggtcttccgaccccgaactccaccggaggcaattgcactgtgtagccgtctgctggagtatacaccaactgcccgactaacaccactggaagcttgtgcacattcattttttgatgaattacgggacccaaatgtcaaactaccaaatgggcgagacacacctgcactcttcaacttcaccactcaagaactgtcaagtaatccacctctggctaccatccttattcctcctcatgctcggattcaagcagctgcttcaacccccacaaatgccacagcagcgtcagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatattaaaaagagaaaaaaatcctgttcattttagtgttcaatttttttattattattgttgttcttatttaaccttgtaaaatatctataaatacaaaccaatttcattgtattctcactttgagggagatccagggggtgggaggggttgtggggagggggaaagcggagcactagaacatacaatctctctcccacgacaatctttttttattaaaagtctgctgttgtatactttaaaaacaggactcctgcctcatgccccttccacaaaagaagaaaacctttttctgtgctgatgggtttttttgaactttgttttcttttaaagtctagtgtgagactttggtatagtgcacagcttgaaattggttgggagcttagcaggtataactcaacggggacttaaatgtcacttgtaaaattaatccatatcttcgggtatttatagacttgcctttggcatgttggtggcaggtgtggcagacaaagaaatgtgtatcattcgtaacccagggaggtcaataaagtttggaactctacagggaagattcttagtagatttgttaaggttttgttttgctctcagttagtgctagtgatgtagaggcttgtacaggaggctgccagaggggaagcagcaagcaagactcaggcacacatgctctacaggtggctctttgtttgcctgaccaaagttctttgcaaatcttagcacagtttcaaactagtgacctgggaggagatggaaggggtgttgagcaggctgagctagctgctgaggtcaaaggctgatgagcccagaggaaggggacaggtcagggatacatctcaccactgtgaataagtttgtccagatttttttctaaagttacttcccttggaaagatacacttgagaggacattgtagttaaataatgtgaactgtaacagtcatctactggtttatttttcatattttttaattgaaaattgagcttgcagaaatagccacattctacacatagttctaattttaaatccaaatctagaatctgtatttaatttgttttttaacctcatgctttttacatttatttattgatgcatgtcagatggtagaaatattaaaaactacacatcagaatgatacagtcacttatacctgctgactttataggaaagctgatgatataaatgtgtgtatatatgttatatatacatatattcaatactgcctttttttttgtctacagtatcaaaattgactggttgaagcatgagaagaatgtttcccccacacccagttaagagtttttgtgtctgttttctttgtgtatcagtgaacgatgttaagaatcagtctctctttttgaagaaaaagcaatattccttggaaagcaaggagaattgaaggactatgtttgccgtgaggaaatagattttcatgactagtttgttttatacttttaaggttggcatctatgtgggccttatatactctaaaatgaactttagtcaccttggtgcttatgggccattacttgacctatgaatctttaaggcacaatcagttgtactttacatttaaagatcacttgagtgatggccgcctttccctcctacccgctccttccccacatgccttccaaggttagctggtaactgtagggctgcagagctgagcccatggttgtgtgtaacttgccctcaccctcctcattgccaccttaggtcactttatgggtctcgtcctccagagggttcggaagtggagtctgttggcagccctcctgcaggccctagcaccctgtcctgctccttaactgtgtgtgtgactctccaagagagttgtcctgcctgctgaagtgaaccagtacccagaaagacaactgtgagccatcttggttttcactcgctgtttagctgaggtcttgggccacaaaaggggtttcacaaacctctggatatatcagagtttatgagaaaggaaacatgctcagtcaaaccaaatcaaacaaattgaattttatgttttataaagtgcttctgaaagctaagatttgaaagaagtctgaaatcaaagtatttggcagcataactccttaaaggtagtggcgttgatagaccattttcagacagaatttataaagaatctgaaaaggcaggtctgtgatagagaaatggacctgcattcagatccaactgcccagcaagcgtttggatgcagacactgctctggacgtggtatactccccagagtccataaaaatcagtgcttattttaggaaacaggttgccccccacaactggggtaaaagaagagagaaaagtcacgcttttctctcatttcattgtgtgtgcatgtgtgcgtgtgtgtgtgtgtgtgtgtgtgctgagatgtgtgatttttctttctcaaggatcatggtgggatcacagaactcttttatacaagtgagatccaggtctctgaatatctttttgtatataataataataaaaagctcctcaccaaattcaagcttgtacattatattttctttctgtgtttttaaatttaagttttattgttttgtatgtaaatatgtggacccaggaactgttattaatgagcaaaaagttactgttcagggcagtgattctgtttaataatcagacaaaatgtagacgagctttttaaagccatatagttttaactctgtacagtaggtaccggcctgtattattgtaacaataactctagcaatgtatagtgtatctatatagtttggagtgccttcgcttccatgtgtttttttttttaatttgttcttttttaaattttaattggtttcctttatccatgtctccctgtccaccccctttccctttgaaataataactcactcataacagtatctttgccccttccacagttaagtttcagtgataccatactcaggagtgggaagaggaaatcatattcgtaatttcatttcgttgaagccctgcctttgttttggttctgaatgtctttcctcctcggtagcagtgagaccggtttcatttcatacttagtccattcagggacttagtgtagcaccagggagccctagagctggaggatatcgaatagattaaattttgctcgtctcttccacaagccctaaccatgggtcttaaaaacagcagattctgggagccttccatgctctctctctctcctcttttatctacttccctcccaaatgagagagtgacagagaattgtttttttataaatcgaagtttcttaatagtatcaggttttgatacgtcagtggtctaaaatgctatagtgcaattactagcagttactgcacggagtgccaccgtgccaatagaggactgttgttttaacaagggaactcttagcccatttcctccctcccgccatctctacccttgctcaatgaaatatcattttaatttcttttaaaaaaaatcagtttaattcttactgtgtgcccaacacgaaggccttttttgaaagaaaaatagaatgttttgcctcaaagtagtccatataaaatgtcttgaatagaagaaaaaactaccaaaccaaaggttactatttttgaaacatcgtgtgttcattccagcaaggcagaagactgcaccttctttccagtgacatgctgtgtcattttttttaagtcctcttaatttttagacacatttttggtttatgttttaacaatgtatgcctaaccagtcatcttgtctgcaccaatgcaaaggtttctgagaggagtattctctatccctgtggatatgaagacactggcatttcatctatttttccctttcctttttaaaggatttaactttggaatcttccaaaggaagtttggccaatgccagatccccaggaatttggggggttttctttcttttcaactgaaattgtatctgattcctactgttcatgttagtgatcatctaatcacagagccaaacacttttctcccctgtgtggaaaagtaggtatgctttacaataaaatctgtcttttctggtagaaacctgagccactgaaaataaaagagacaactagaagcacagtagagtcccagactgagatctacctttgagaggctttgaaagtaatccctggggtttggattattttcacaagggttatgccgttttattcaagtttgttgctccgttttgcacctctgcaataaaagcaaaatgacaaccagtacataaggggttagcttgacaaagtagacttccttgtgttaatttttaagtttttttttccttaactatatctgtctacaggcagatacagatagttgtatgaaaatctgcttgcctgtaaaatttgcatttataaatgtgttgccgatggatcacttgggcctgtacacataccaattagcgtgaccacttccatcttaaaaacaaacctaaaaaacaaaatttattatatatatatatatatatatataaaggactgtgggttgtatacaaactattgcaaacacttgtgcaaatctgtcttgatataaaggaaaagcaaaatctgtataacattattactacttgaatgcctctgtgactgatttttttttcattttaaatataaacttttttgtgaaaagtatgctcaatgttttttttccctttccccattcccttgtaaatacattttgttctatgtgacttggtttggaaatagttaactggtactgtaatttgcattaaataaaaagtaggttagcctggaaatgaaattaaaattcacaagtgtgtggtctttatttcagtacccaaccctcttccttcaccctactattttgccgctgcaatatgtagtcacatcaccatttccattcctctaattagggaaacattaatctttgttatacagaacaagatatcaataccacttcttgttctttccaatgattttattccattgtgtagccccaagaggtgcagcttccaccttggaaacctttggatttgatgtagaggaagctttgcagacactgcttagaaaagaaagaaaacaactctgaaagggacagtttttaaatgtgtataagctgctgtctttgattactgtgttcatgatttggtgtggctgtattttcttttaactttcatcctattagtaatggtctttgggggtctctgtaaaatatatggacaccacgaacagtggggctgtacctcccaggtaaccaacacatgttgtgtttgagtctgctcatttccaatactggatgatgtatgtaaacatgttatgtctcttagtgcaaaaagaaacatcatttttttagggctggctcactctgtcaggcctaatctaaaggctagatataaggtcatgtgactgctgcttcaataaaaacaaatttatattc

SEQ ID NO: 138041 - DNA, 1636 bp, Homo sapiens
  Payload ID: 7040
  Gene Symbol: GSK3B
  Gene Name: glycogen synthase kinase 3 beta
  Uniprot ID: P49841
  ENST ID: ENST00000316626
  CDS Start-End: 233-1534
atcatctatatgttaaatatccgtgccgatctgtcttgaaggagaaatatatcgcttgttttgttttttatagtatacaaaaggagtgaaaagccaagaggacgaagtctttttctttttcttctgtgggagaacttaatgctgcatttatcgttaacctaacaccccaacataaagacaaaaggaagaaaaggaggaaggaaggaaaaggtgattcgcgaagagagtgatcatgtcagggcggcccagaaccacctcctttgcggagagctgcaagccggtgcagcagccttcagcttttggcagcatgaaagttagcagagacaaggacggcagcaaggtgacaacagtggtggcaactcctgggcagggtccagacaggccacaagaagtcagctatacagacactaaagtgattggaaatggatcatttggtgtggtatatcaagccaaactttgtgattcaggagaactggtcgccatcaagaaagtattgcaggacaagagatttaagaatcgagagctccagatcatgagaaagctagatcactgtaacatagtccgattgcgttatttcttctactccagtggtgagaagaaagatgaggtctatcttaatctggtgctggactatgttccggaaacagtatacagagttgccagacactatagtcgagccaaacagacgctccctgtgatttatgtcaagttgtatatgtatcagctgttccgaagtttagcctatatccattcctttggaatctgccatcgggatattaaaccgcagaacctcttgttggatcctgatactgctgtattaaaactctgtgactttggaagtgcaaagcagctggtccgaggagaacccaatgtttcgtatatctgttctcggtactatagggcaccagagttgatctttggagccactgattatacctctagtatagatgtatggtctgctggctgtgtgttggctgagctgttactaggacaaccaatatttccaggggatagtggtgtggatcagttggtagaaataatcaaggtcctgggaactccaacaagggagcaaatcagagaaatgaacccaaactacacagaatttaaattccctcaaattaaggcacatccttggactaaggattcgtcaggaacaggacatttcacctcaggagtgcgggtcttccgaccccgaactccaccggaggcaattgcactgtgtagccgtctgctggagtatacaccaactgcccgactaacaccactggaagcttgtgcacattcattttttgatgaattacgggacccaaatgtcaaactaccaaatgggcgagacacacctgcactcttcaacttcaccactcaagaactgtcaagtaatccacctctggctaccatccttattcctcctcatgctcggattcaagcagctgcttcaacccccacaaatgccacagcagcgtcagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatattaaaaagagaaaaaaa

SEQ ID NO: 138042 - DNA, 1890 bp, Homo sapiens
  Payload ID: 7041
  Gene Symbol: GYG1
  Gene Name: glycogenin 1
  Uniprot ID: P46976
  ENST ID: ENST00000296048
  CDS Start-End: 190-1191
ccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagtgtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 138043 - DNA, 2052 bp, Homo sapiens
  Payload ID: 7041
  Gene Symbol: GYG1
  Gene Name: glycogenin 1
  Uniprot ID: P46976
  ENST ID: ENST00000345003
  CDS Start-End: 301-1353
agcaggggcgccggtgagccgcagccgcagcggcagcctagccccgagggagggaggaggagccgagggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagtgtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtgctttcagacttggtctatacactggctttctcttgtggcttctgtagaaaggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 138044 - DNA, 713 bp, Homo sapiens
  Payload ID: 7041
  Gene Symbol: GYG1
  Gene Name: glycogenin 1
  ENST ID: ENST00000473005
  CDS Start-End: 534-713
gccacaaagattgcaggtgtaacccagagttcagccgtctttaggaagattaaactcctacccagctgtcattggtctttcttggtcatttgtaatgttggctagtctggtgttctaacctgtgttctatcccttatttaatcttggaaatcatccatatccttgcttccagaaatccttgaatcctgctcaccttattacatttttctccatgatcgcctggaacctggacttcatttgagttagatgatcattcattttgcctagcttaagtatttttggtacagattgacagcgatgttacccatgttataatgggctgaagataatagaagcaagtacaggcggatgttgatgggcctgtcaagggacaggtgccactgttcagagctttcctagagtatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctg

SEQ ID NO: 138045 - DNA, 657 bp, Homo sapiens
  Payload ID: 7041
  Gene Symbol: GYG1
  Gene Name: glycogenin 1
  ENST ID: ENST00000492285
  CDS Start-End: 327-657
ctccctcccggtgccggcttctctgagtcaccaacctgaggctgccccggccgcctgcgcacccggcagcaccatgacagattgacagcgatgttacccatgttataatgggctgaagataatagaagcaagtacaggcggatgttgatgggcctgtcaagggacaggtgccactgttcagagctttcctagagtatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaag

SEQ ID NO: 138046 - DNA, 801 bp, Homo sapiens
  Payload ID: 7041
  Gene Symbol: GYG1
  Gene Name: glycogenin 1
  ENST ID: ENST00000483267
  CDS Start-End: 130-711
ataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacct

SEQ ID NO: 138047 - DNA, 866 bp, Homo sapiens
  Payload ID: 7041
  Gene Symbol: GYG1
  Gene Name: glycogenin 1
  ENST ID: ENST00000461191
  CDS Start-End: 70-866
ctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtggggaccaaggcatactgaacacattttttagcagctgggcaacaacagatatcagaaaacacctgccgtttatttataacctaagcagcatctctatatactcctacctcccggcatttaaagtgtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacac

SEQ ID NO: 138048 - DNA, 1563 bp, Homo sapiens
  Payload ID: 7041
  Gene Symbol: GYG1
  Gene Name: glycogenin 1
  Uniprot ID: P46976
  ENST ID: ENST00000484197
  CDS Start-End: 84-923
gctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagtgaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgt

SEQ ID NO: 138049 - DNA, 1831 bp, Homo sapiens
  Payload ID: 7041
  Gene Symbol: GYG1
  Gene Name: glycogenin 1
  ENST ID: ENST00000627418
  CDS Start-End: 234-815
ggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgtatcttggttgtttaattaaattaaggaatttcaccat

SEQ ID NO: 138050 - DNA, 731 bp, Homo sapiens
  Payload ID: 7042
  Gene Symbol: GYG2
  Gene Name: glycogenin 2
  ENST ID: ENST00000381157
  CDS Start-End: 1-731
gctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatatgatagcttgtcctgaaactgagactcctgccgtgataacgtgtgacccactgtcccagccttcccctcagcctgcagacttcacagagactgaaaccatcttggtcgacctggccgtctctgtttcccagatctccatcgaag

SEQ ID NO: 138051 - DNA, 3393 bp, Homo sapiens
  Payload ID: 7042
  Gene Symbol: GYG2
  Gene Name: glycogenin 2
  Uniprot ID: O15488
  ENST ID: ENST00000381163
  CDS Start-End: 283-1788
cgcgggcttgcgggcaggggctgcagggaggaggagaggacccgcgcccgcgggggctggcggaggcggggccgggcttccggacagaggccaatcgctgccctcggggcctccagcgccggctctgggccgaggcagccagagcgcggaagaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcggagacagagtttcaccatggtgcccaggctggtctcgaactcctgaggtcaagcaattcacccacctcagcctcccaaagtgctggaatgacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatatgatagcttgtcctgaaactgagactcctgccgtgataacgtgtgacccactgtcccagccttcccctcagcctgcagacttcacagagactgaaaccatcttgcagccagcaaataaagtcgaaagtgtctcatccgaggaaaccttcgaaccaagccaggaactccctgctgaggctctcagggaccccagtctgcaggatgcactggaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatggttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgaggctcgtaggatatttcaggtgagtcagggttggatggtcatcggctttcagaaggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaaca

SEQ ID NO: 138052 - DNA, 1956 bp, Homo sapiens
  Payload ID: 7042
  Gene Symbol: GYG2
  Gene Name: glycogenin 2
  Uniprot ID: O15488
  ENST ID: ENST00000398806
  CDS Start-End: 317-1729
cttcccggcagccggggctgggcaccaggcggcgcgcgggcttgcgggcaggggctgcagggaggaggagaggacccgcgcccgcgggggctggcggaggcggggccgggcttccggacagaggccaatcgctgccctcggggcctccagcgccggctctgggccgaggcagccagagcgcggaagaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcggtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatatgatagcttgtcctgaaactgagactcctgccgtgataacgtgtgacccactgtcccagccttcccctcagcctgcagacttcacagagactgaaaccatcttgcagccagcaaataaagtcgaaagtgtctcatccgaggaaaccttcgaaccaagccaggaactccctgctgaggctctcagggaccccagtctgcaggatgcactggaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcaga

SEQ ID NO: 138053 - DNA, 624 bp, Homo sapiens
  Payload ID: 7042
  Gene Symbol: GYG2
  Gene Name: glycogenin 2
  ENST ID: ENST00000520904
  CDS Start-End: 212-624
agtgcgccgagccagggcaccgagtgctggggaatacaggccgtccaggcgcggcggggcgcggggagacggaggctgccggagcctggaaatccacgcggattcccggagacggcgcctctgctctgcgggttcgtggcgaggaagtccacccactgctcccgggcgcaggtctgcaggtccgcgcccactgcccgcggcgccactgaccatgtcggtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggt

SEQ ID NO: 138054 - DNA, 1293 bp, Homo sapiens
  Payload ID: 7042
  Gene Symbol: GYG2
  Gene Name: glycogenin 2
  Uniprot ID: O15488
  ENST ID: ENST00000353656
  CDS Start-End: 1-1293
atgtcggagacagagtttcaccatggtgcccaggctggtctcgaactcctgaggtcaagcaattcacccacctcagcctcccaaagtgctggaatgacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatgtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaa

SEQ ID NO: 138055 - DNA, 2356 bp, Homo sapiens
  Payload ID: 7043
  Gene Symbol: GLTP
  Gene Name: glycolipid transfer protein
  Uniprot ID: Q9NZD2
  ENST ID: ENST00000318348
  CDS Start-End: 115-744
ccggagcctgcggcgggcggctgtgacggccccggcgctgacggcggcggccgggggggcggtgtcgacgcccgcggcgccggctggggcatcaccgcgggcctcgaccccgaaatggcgctgctggccgaacacttgctgaagccgctgcccgcggacaagcagatcgagaccgggcccttcctcgaggcggtgtcccacctgccgcccttcttcgattgccttgggtccccagtgtttactcccatcaaggcagacataagcggcaacatcacgaaaatcaaagctgtgtacgacaccaacccagccaagttccggaccctgcagaacatcctggaggtggagaaagaaatgtatggagcagagtggcccaaagtaggggccacactggcgctgatgtggctgaaaagaggcctccgcttcatccaggtcttcctccagagcatctgcgacggggagcgggacgagaaccaccccaacctcatccgtgtcaacgccaccaaggcctacgagatggccctcaagaagtaccatggctggatcgtgcagaagatcttccaggcagcactgtacgcagcaccctataagtctgacttcctgaaagcgctctccaaggggcagaatgttacggaggaggagtgcctggagaagatccgcctcttcctagtcaactacacggcgaccatcgatgtcatctacgagatgtacacccagatgaacgctgagcttaactacaaggtgtaggcatgcccactgctggacacgtccccgactcgtggccacatggagaaacaggcaaaccagaatcactgtgaatcaagtcggtgaactgcccctggcctgtgtcccccagagcagcccagggtcctgccagagtctgcaggggacagccctcgttttttaagtcttttttttttttttttttggtctattctaaaggaccagtaaataatgatcttacttccaaatctccttggaatttcacgacagcacagactgactttataccttcatttcagcgtggtaaaaaccgattaacacttctaatgagtcaagtcctagggttttttggttttgttttgttgccaacgaggaacacagctctgggggaatggtgtcatccacctcgctttaaaaataagcacatgatggctgggcaccgtggctcacgcctgtaatcccagcactttgggaggctgaggcgggtggatcacctgaggtcgggagtttgagaccagcctggccaacatggtgaaaccccatcgctactaaaaatataaaaaattagctgggcatggtggcgcacgcctgtagttccagctactcaggaggctgaggcaggagaatcgcttgaacccgggaggtggaggttgcagtgagctgagatcgcaccattgcactccagcctgggcaacaagagcgaaactctgtctcaaaaaaaaaaaaaagaggtgggtggattacttgaggtcagggtttgagatcagcctgaccaacatggtgaaaccctatctctactaaaaatatagaattagccaggcatggtagcgcacgcctgtaatcccatcttcttgggaggctgaggcaggagaatcgctagaaactgggaggtggaggttacagtagccgagatcgcgccactgcattccagcctgggcaacaaaagcgaaactctgtctcaaaaaagaaaaaaaagaaaaaaaagcacgtgaccttatgaggctctcgctgtattgttattttaaggactataaagagtttgatttaaaattatgcagggcccctatgtgggattttttaaaaagcaaactggtgtgtattctcatgtggtttgcacagcccagcctcacagcactattgtaaaccctgctctttctgtctcgctagacagatttttttgtttgttttcttttttctggttgttttttgttgttgttgttgttgttttacagctgaaaccaaccagcaagcccttgatgaccaagaggcgtttctttcaaagctatagggcacaaacaattgaccatagatgactccgtttgcattcttctgcagaattatttccttcagggacagattttccaacctaagaaactacctaccgtgtgtattctcttgacggggagagatgaacccttcagctgctaagatccaagaaaacgcctcactgccttaaccttaactgttcttcctggcgctaaaaagagctgtattttttaaagtgctggggcaaacaaagcaaccccaaaagagttgatgtgtgttttaaaagaaaaaacccaatgaggaacaattggagatttttatgcagaaactaaataatccttaataaataaatctctattttggaatcaca

SEQ ID NO: 138056 - DNA, 791 bp, Homo sapiens
  Payload ID: 7043
  Gene Symbol: GLTP
  Gene Name: glycolipid transfer protein
  ENST ID: ENST00000537066
  CDS Start-End: 5-208
cgaaatggcgctgctggccgaacacttgctgaagccgctgcccgcggacaagcagatcgagaccgggcccttcctcgaggcggtgtcccacctgccgcccttcttcgattgccttgggtccccagtgtttactcccatcaaggcagacataagcggcaacatcacgatgaggaagctgagactcagaggggttgaaggactcgcttaaggtcacaagcaagtacgtggcaaagctgggattcagacccaggcctacctggctccatctcagaggccttcgttcctggacttcttggaatcctcggaacctatttccacttgtccaccaaagcaaaacttcagatacttggtgtctgaggcagtgtcagtagtggctggagaacatgaactctgtaccaactgtgtgaccttgggcaagtccgtgctcctctgtgagcctcagtgtctctgcctgtaaaatgggataatgacagcaacatcaggtttgccaccaggatcatataagaaaatcaaagctgtgtacgacaccaacccagccaagttccggaccctgcagaacatcctggaggtggagaaagaaatgtatggagcagagtggcccaaagtaggggccacactggcgctgatgtggctgaaaagaggcctccgcttcatccaggtcttcctccagagcatctgcgacggggagcgggacgagaaccaccccaacctcatccgtgtcaacgccaccaaggcctacgagatggccctcaagaagtaccatggctggatcgtgcagaagatcttccagg

SEQ ID NO: 138057 - DNA, 560 bp, Homo sapiens
  Payload ID: 7043
  Gene Symbol: GLTP
  Gene Name: glycolipid transfer protein
  ENST ID: ENST00000540772
  CDS Start-End: 1-550
agatcgagaccgggcccttcctcgaggcggtgtcccacctgccgcccttcttcgattgccttgggtccccagtgtttactcccatcaaggcagacataagcggcaacatcacgaaaatcaaagctgtgtacgacaccaacccagccaagttccggaccctgcagaacatcctggaggtggagaaagaaatgtatggagcagagtggcccaaagtaggggccacactggcgctgatgtggctgaaaagagcatctgcgacggggagcgggacgagaaccaccccaacctcatccgtgtcaacgccaccaaggcctacgagatggccctcaagaagtaccatggctggatcgtgcagaagatcttccaggcagcactgtacgcagcaccctataagtctgacttcctgaaagcgctctccaaggggcagaatgttacggaggaggagtgcctggagaagatccgcctcttcctagtcaactacacggcgaccatcgatgtcatctacgagatgtacacccagatgaacgctgagcttaactacaaggtgtaggcatgcccac

SEQ ID NO: 138058 - DNA, 583 bp, Homo sapiens
  Payload ID: 7043
  Gene Symbol: GLTP
  Gene Name: glycolipid transfer protein
  ENST ID: ENST00000536390
  CDS Start-End: 10-213
gaccccgaaatggcgctgctggccgaacacttgctgaagccgctgcccgcggacaagcagatcgagaccgggcccttcctcgaggcggtgtcccacctgccgcccttcttcgattgccttgggtccccagtgtttactcccatcaaggcagacataagcggcaacatcacgatgaggaagctgagactcagaggggttgaaggactcgcttaaggtcacaagcaaaaaatcaaagctgtgtacgacaccaacccagccaagttccggaccctgcagaacatcctggaggtggagaaagaaatgtatggagcagagtggcccaaagtaggggccacactggcgctgatgtggctgaaaagaggcctccgcttcatccaggtcttcctccagagcatctgcgacggggagcgggacgagaaccaccccaacctcatccgtgtcaacgccaccaaggcctacgagatggccctcaagaagtaccatggctggatcgtgcagaagatcttccaggcagcactgtacgcagcaccctataagtctgacttcctgaaagcgctctccaaggggcagaatgttacggagg

SEQ ID NO: 138059 - DNA, 914 bp, Homo sapiens
  Payload ID: 7043
  Gene Symbol: GLTP
  Gene Name: glycolipid transfer protein
  ENST ID: ENST00000544393
  CDS Start-End: 48-620
acgcccgcggcgccggctggggcatcaccgcgggcctcgaccccgaaatggcgctgctggccgaacacttgctgaagccgctgcccgcggacaagcagatcgagaccgggcccttcctcgaggcggtgtcccacctgccgcccttcttcgattgccttgggtccccagtgtttactcccatcaaggcagacataagcggcaacatcacgaaaatcaaagctgtgtacgacaccaacccagccaagttccggaccctgcagaacatcctggaggtggagaaagaaataggcctccgcttcatccaggtcttcctccagagcatctgcgacggggagcgggacgagaaccaccccaacctcatccgtgtcaacgccaccaaggcctacgagatggccctcaagaagtaccatggctggatcgtgcagaagatcttccaggcagcactgtacgcagcaccctataagtctgacttcctgaaagcgctctccaaggggcagaatgttacggaggaggagtgcctggagaagatccgcctcttcctagtcaactacacggcgaccatcgatgtcatctacgagatgtacacccagatgaacgctgagcttaactacaaggtgtaggcatgcccactgctggacacgtccccgactcgtggccacatggagaaacaggcaaaccagaatcactgtgaatcaagtcggtgaactgcccctggcctgtgtcccccagagcagcccagggtcctgccagagtctgcaggggacagccctcgttttttaagtcttttttttttttttttttggtctattctaaaggaccagtaaataatgatcttacttccaaatctccttggaatttcacgacagcacagactgactttataccttcatttcagcgtggtaaaaaccgattaa

SEQ ID NO: 138060 - DNA, 969 bp, Homo sapiens
  Payload ID: 7043
  Gene Symbol: GLTP
  Gene Name: glycolipid transfer protein
  ENST ID: ENST00000617457
  CDS Start-End: 1-204
atggcgctgctggccgaacacttgctgaagccgctgcccgcggacaagcagatcgagaccgggcccttcctcgaggcggtgtcccacctgccgcccttcttcgattgccttgggtccccagtgtttactcccatcaaggcagacataagcggcaacatcacgatgaggaagctgagactcagaggggttgaaggactcgcttaaggtcacaagcaagtacgtggcaaagctgggattcagacccaggcctacctggctccatctcagaggccttcgttcctggacttcttggaatcctcggaacctatttccacttgtccaccaaagcaaaacttcagatacttggtgtctgaggcagtgtcagtagtggctggagaacatgaactctgtaccaactgtgtgaccttgggcaagtccgtgctcctctgtgagcctcagtgtctctgcctgtaaaatgggataatgacagcaacatcaggtttgccaccaggatcatataagaaaatcaaagctgtgtacgacaccaacccagccaagttccggaccctgcagaacatcctggaggtggagaaagaaatgtatggagcagagtggcccaaagtaggggccacactggcgctgatgtggctgaaaagaggcctccgcttcatccaggtcttcctccagagcatctgcgacggggagcgggacgagaaccaccccaacctcatccgtgtcaacgccaccaaggcctacgagatggccctcaagaagtaccatggctggatcgtgcagaagatcttccaggcagcactgtacgcagcaccctataagtctgacttcctgaaagcgctctccaaggggcagaatgttacggaggaggagtgcctggagaagatccgcctcttcctagtcaactacacggcgaccatcgatgtcatctacgagatgtacacccagatgaacgctgagcttaactacaaggtgtag

SEQ ID NO: 138061 - DNA, 1023 bp, Homo sapiens
  Payload ID: 7044
  Gene Symbol: GLTPD2
  Gene Name: glycolipid transfer protein domain containing 2
  Uniprot ID: A6NH11
  ENST ID: ENST00000331264
  CDS Start-End: 54-929
gggacacggactggctaggcgctggtgagggggcggcggtcccagcagcaggcatgggagtggcggcgcggcccccagccctgcggcactggttcagccactcaattcctctcgctatcttcgcgctgctgctgctttatctcagtgttcggagcctaggcgcccgctcgggctgcggacccagggcgcagccctgcgttccaggggaaacggcgcccttccaggtccggcaggagtcgggaaccctggaggccccggagaggaaacagcctccgtgtctgggccctcgggggatgctgggccgcatgatgaggcggttccacgccagtctgaaacccgaaggggatgtggggctgtcgccgtacctggcgggatggagggcactcgtcgagttcctgactcccctcggctccgtcttcgccttcgccactagggaggccttcaccaaggtgacagacctggaggctcgggtgcacggcccggacgcggagcactactggtcgctggtggccatggcggcgtgggagcggagggcgggactgctggagcagccgggggcggccccccgggacccgacccggagctcgggctctcgcacgctgctcctgctgcaccgcgcgctgcgctggtcccagctctgcctccaccgggtggcgaccggcgcgctgggaggcccggacgcgggcgtgcagtgcagcgacgcctaccgtgcggccctgggtccgcatcacccctggctggtccgacagaccgcccgcctcgccttcctcgccttcccgggtcgccgccgcctgctggagctggcgtgtcccggagccaccgaggcggaggcgcgggccgcgctggtccgggccgccggcaccttggaggatgtctacaaccgcacccagagcctgctggccgagcgcggcctgctccagctggcctaagacggcggctgcggggaccggcgggaacggagcggaccgcccggggtggggccgcgcagcccggggtcagtcctgcagcccgcgccgcggccgc

SEQ ID NO: 138062 - DNA, 751 bp, Homo sapiens
  Payload ID: 7045
  Gene Symbol: GYPA
  Gene Name: glycophorin A (MNS blood group)
  Uniprot ID: P02724
  ENST ID: ENST00000324022
  CDS Start-End: 59-412
gcagttgtctttggtagtttttttgcactaacttcaggaaccagctcatgatctcaggatgtatggaaaaataatctttgtattactattgtcagatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgt

SEQ ID NO: 138063 - DNA, 2659 bp, Homo sapiens
  Payload ID: 7045
  Gene Symbol: GYPA
  Gene Name: glycophorin A (MNS blood group)
  ENST ID: ENST00000360771
  CDS Start-End: 117-569
gcaggaaggtgggcctggaagataacagctagcaggctaaggtcagacactgacacttgcagttgtctttggtagtttttttgcactaacttcaggaaccagctcatgatctcaggatgtatggaaaaataatctttgtattactattgtcagaaattgtgagcatatcagcattaagtaccactgaggtggcaatgcacacttcaacttcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacacacacacacacaaacacacacatttatcatttaatgcataaatcaacacaaaaggttttcccattaatatgaaatattacatatatataagtgccatatttaaaataatttgtctaacagtagaactgtgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttgcatattttcaggcatggtaacagaaatttaccttttaataaattaaaaaatctaaattttaacctacttgtatgttcggagagtgtttttgtactatattgactacttaaaatagagaatgagactaagaagggaacatttctgttgatacatgttttttaaaagtaattttaagagcattattaggttaattaatccaattaatgacccaaatgccaaggtaattttaaatttacatttttaataaaagcaacatgttgaaacaagagagggtgagattaacctttttgctaaagtaatttacaagtcaaagacaggaagagatcagagtgaatgtgccttcttaaccagagctacagaatttagtgaataattaaagtacaaactgctttgacctccttgaacttttccaagcaatttctctgtacttctatatatgaatgtcttagccaattttctgctactataacagaatacgacagactgggtaatttaaaaagaaaagaaatttattttcttcctagttctggaggctgggaaggcgaagggcatggcactgacatctgccttgtaactgatgagaaccttcttactgcatgataacaaagcagcaaggcaagcaaaagcgtaagatgaagagagaggaaatgaagccaaacacatcctttcatcagaagcccattccctctataaggcgttattacatttatgagaatggagtcctcatgacctaatcgtgaccttaaaggcccctcccaacactgttacaatggcaattaaatttcaacaaaggttccagaggtgacattcgaatcagcaatgaaattttcatagttaaatttggtattcgtgggggaagaaatgaccatttcccttgtatttttataattaaatcagcaaaatattgtaataaagaaatctttcctgtgaagataccatgacccc

SEQ ID NO: 138064 - DNA, 318 bp, Homo sapiens
  Payload ID: 7045
  Gene Symbol: GYPA
  Gene Name: glycophorin A (MNS blood group)
  ENST ID: ENST00000503627
  CDS Start-End: 1-318
atgtatggaaaaataatctttgtattactattgtcagaaattgtgagcatatcagcattaagtaccactgaggtggcaatgcacacttcaacttcttcttcagtcacaaagagttacatctcatcacagacaaatgagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatga

SEQ ID NO: 138065 - DNA, 258 bp, Homo sapiens
  Payload ID: 7045
  Gene Symbol: GYPA
  Gene Name: glycophorin A (MNS blood group)
  ENST ID: ENST00000512789
  CDS Start-End: 1-258
atgtatggaaaaataatctttgtattactattgtcaggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatga

SEQ ID NO: 138066 - DNA, 357 bp, Homo sapiens
  Payload ID: 7045
  Gene Symbol: GYPA
  Gene Name: glycophorin A (MNS blood group)
  ENST ID: ENST00000504786
  CDS Start-End: 1-357
atgtatggaaaaataatctttgtattactattgtcagaaattgtgagcatatcagcattaagtaccactgaggtggcaatgcacacttcaacttcttcttcagtcacaaagagttacatctcatcacagacaaatggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatga

SEQ ID NO: 138067 - DNA, 622 bp, Homo sapiens
  Payload ID: 7045
  Gene Symbol: GYPA
  Gene Name: glycophorin A (MNS blood group)
  ENST ID: ENST00000508337
  CDS Start-End: 38-166
tttgcactaacttcaggaaccagctcatgatctcaggatgtatggaaaaataatctttgtattactattgtcaggagacggagccaaccctgaaaattctgggaaaagaggacagaaggcagagggaagagcaagagcaaaaattctgaaacagcagaaattgtgagcatatcagcattaagtaccactgaggtggcaatgcacacttcaacttcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataag

SEQ ID NO: 138068 - DNA, 441 bp, Homo sapiens
  Payload ID: 7045
  Gene Symbol: GYPA
  Gene Name: glycophorin A (MNS blood group)
  ENST ID: ENST00000512064
  CDS Start-End: 1-414
atgtatggaaaaataatctttgtattactattgtcagaaattgtgagcatatcagcattaagtaccactgaggtggcaatgcacacttcaacttcttcttcagtcacaaagagttacatctcatcacagacaaatgatacgcacaaacgggacacatatgcagccactcctagagctcatgaagtttcagaaatttctgttagaactgtttaccctccagaagaggaaaccgagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtgga

SEQ ID NO: 138069 - DNA, 695 bp, Homo sapiens
  Payload ID: 7045
  Gene Symbol: GYPA
  Gene Name: glycophorin A (MNS blood group)
  ENST ID: ENST00000535709
  CDS Start-End: 199-645
gcactaacttcaggaaccagctcatgatctcaggatgtatggaaaaataatctttgtattactattgtcagggttcatccagtgattcatttgcaagcaggcatggggtaaggtcttcagagtatgtttctcagaggcccatgcagctaagaaaatgtgcagtgttggcacaaggtctgtctattcctgggtagccagatgctggacacatctttcataacaccacaagaaattgtgagcatatcagcattaagtaccactgaggtggcaatgcacacttcaacttcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataaga

SEQ ID NO: 138070 - DNA, 2538 bp, Homo sapiens
  Payload ID: 7045
  Gene Symbol: GYPA
  Gene Name: glycophorin A (MNS blood group)
  ENST ID: ENST00000616983
  CDS Start-End: 1-447
atgctggacacatctttcataacaccacaagaaattgtgagcatatcagcattaagtaccactgaggtggcaatgcacacttcaacttcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacacacacacacacaaacacacacatttatcatttaatgcataaatcaacacaaaaggttttcccattaatatgaaatattacatatatataagtgccatatttaaaataatttgtctaacagtagaactgtgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttgcatattttcaggcatggtaacagaaatttaccttttaataaattaaaaaatctaaattttaacctacttgtatgttcggagagtgtttttgtactatattgactacttaaaatagagaatgagactaagaagggaacatttctgttgatacatgttttttaaaagtaattttaagagcattattaggttaattaatccaattaatgacccaaatgccaaggtaattttaaatttacatttttaataaaagcaacatgttgaaacaagagagggtgagattaacctttttgctaaagtaatttacaagtcaaagacaggaagagatcagagtgaatgtgccttcttaaccagagctacagaatttagtgaataattaaagtacaaactgctttgacctccttgaacttttccaagcaatttctctgtacttctatatatgaatgtcttagccaattttctgctactataacagaatacgacagactgggtaatttaaaaagaaaagaaatttattttcttcctagttctggaggctgggaaggcgaagggcatggcactgacatctgccttgtaactgatgagaaccttcttactgcatgataacaaagcagcaaggcaagcaaaagcgtaagatgaagagagaggaaatgaagccaaacacatcctttcatcagaagcccattccctctataaggcgttattacatttatgagaatggagtcctcatgacctaatcgtgaccttaaaggcccctcccaacactgttacaatggcaattaaatttcaacaaaggttccagaggtgacattcgaatcagcaatgaaattttcatagttaaatttggtattcgtgggggaagaaatgaccatttcccttgtatttttataattaaatcagcaaaatattgtaataaagaaatctttcctgtgaagataccatgacccca

SEQ ID NO: 138071 - DNA, 239 bp, Homo sapiens
  Payload ID: 7046
  Gene Symbol: GYPB
  Gene Name: glycophorin B (MNS blood group)
  ENST ID: ENST00000429670
  CDS Start-End: 51-239
ctttggtagtttttttgcactaacttcaggaaccagctcatgatctcaggatgtatggaaaaataatctttgtattactattgtcagaaattgtgagcatatcagcattaagtaccactgaggtggcaatgcacacttcaacctcttcttcagtcacaaagagttacatctcatcacagacaaatggagaaacgggacaacttgtccatcgtttcactgtaccagtattcgccgactga

SEQ ID NO: 138072 - DNA, 632 bp, Homo sapiens
  Payload ID: 7046
  Gene Symbol: GYPB
  Gene Name: glycophorin B (MNS blood group)
  ENST ID: ENST00000504951
  CDS Start-End: 38-175
tttgcactaacttcaggaaccagctcatgatctcaggatgtatggaaaaataatctttgtattactattgtcaggaaactttgagcattcagctgaggggccaagttggctgcctctgagaagaagcccttccacctccactccactgcacttgggtgccattcccctcatttgaatgtctccaagagatgagcaaagaaattgtgagcatatcagcattaagtaccactgaggtggcaatgcacacttcaacctcttcttcagtcacaaagagttacatctcatcacagacaaatgataagcacaaacgggacacatgtccagctcatactgctaatgaagtttcagaaatttctgttacaactgtttcccctccagaaaagaaaaacggagaaacgggacaacttgtccatcgtttcactgtaccagctcctgtagtgataatactcattattttgtgtgtgatggctggtattattggaacgatcctcttaatttcttacagtattcgccgactgataaaggcatgaggatgtggcctgcatgctgcctgatcttgcctagaaccggctgcacctgctgttctcttgtttatgcaaactggctgcacctgctattcctttgcttatgcc

SEQ ID NO: 138073 - DNA, 606 bp, Homo sapiens
  Payload ID: 7046
  Gene Symbol: GYPB
  Gene Name: glycophorin B (MNS blood group)
  ENST ID: ENST00000506679
  CDS Start-End: 53-181
gtctttggtagtttttttgcactaacttcaggaaccagctcatgatctcaggatgtatggaaaaataatctttgtattactattgtcaggagatggagccaaccctgaaaattctgggagaagaggacagaaggcagagggaagagcaagagcaaaaattctgaaacaggagaaattgtgagcatatcagcattaagtaccactgaggtggcaatgcacacttcaacctcttcttcagtcacaaagagttacatctcatcacagacaaatggagaaacgggacaacttgtccatcgtttcactgtaccagctcctgtagtgataatactcattattttgtgtgtgatggctggtattattggaacgatcctcttaatttcttacagtattcgccgactgataaaggcatgaggatgtggcctgcatgctgcctgatcttgcctagaaccggctgcacctgctgttctcttgtttatgcaaactggctgcacctgctattcctttgcttatgcccctacccctggctatcctaattccctgttctcctgcctcactattactgtattctctacttctaaataaaaataaaacaaaatacaaaccgtt

SEQ ID NO: 138074 - DNA, 444 bp, Homo sapiens
  Payload ID: 7046
  Gene Symbol: GYPB
  Gene Name: glycophorin B (MNS blood group)
  ENST ID: ENST00000511198
  CDS Start-End: 38-175
tttgcactaacttcaggaaccagctcatgatctcaggatgtatggaaaaataatctttgtattactattgtcaggaaactttgagcattcagctgaggggccaagttggctgcctctgagaagaagcccttccacctccactccactgcacttgggtgccattcccctcatttgaatgtctccaagagatgagcaaagaaattgtgagcatatcagcattaagtaccactgaggtggcaatgcacacttcaacctcttcttcagtcacaaagagttacatctcatcacagacaaatggagaaacgggacaacttgtccatcgtttcactgtaccaggcatgaggatgtggcctgcatgctgcctgatcttgcctagaaccggctgcacctgctgttctcttgtttatgcaaactggctgcacctgctattcctttgcttatgcc

SEQ ID NO: 138075 - DNA, 583 bp, Homo sapiens
  Payload ID: 7046
  Gene Symbol: GYPB
  Gene Name: glycophorin B (MNS blood group)
  ENST ID: ENST00000505583
  CDS Start-End: 38-175
tttgcactaacttcaggaaccagctcatgatctcaggatgtatggaaaaataatctttgtattactattgtcaggaaactttgagcattcagctgaggggccaagttggctgcctctgagaagaagcccttccacctccactccactgcacttgggtgccattcccctcatttgaatgtctccaagagatgagcaaagaaattgtgagcatatcagcattaagtaccactgaggtggcaatgcacacttcaacctcttcttcagtcacaaagagttacatctcatcacagacaaatggagaaacgggacaacttgtccatcgtttcactgtaccagctcctgtagtgataatactcattattttgtgtgtgatggctggtattattggaacgatcctcttaatttcttacagtattcgccgactgataaaggcatgaggatgtggcctgcatgctgcctgatcttgcctagaaccggctgcacctgctgttctcttgtttatgcaaactggctgcacctgctattcctttgcttatgcccctacccctggctatcctaattccctgttctcctgcctcactat

SEQ ID NO: 138076 - DNA, 473 bp, Homo sapiens
  Payload ID: 7046
  Gene Symbol: GYPB
  Gene Name: glycophorin B (MNS blood group)
  ENST ID: ENST00000506516
  CDS Start-End: 38-97
tttgcactaacttcaggaaccagctcatgatctcaggatgtatggaaaaataatctttgtattactattgtcaggtcaccctacaatgctatgttagaggtacaacactcctaccctcaggctataaacaagaaattgtgagcatatcagcattaagtaccactgaggtggcaatgcacacttcaacctcttcttcagtcacaaagagttacatctcatcacagacaaatggagaaacgggacaacttgtccatcgtttcactgtaccagctcctgtagtgataatactcattattttgtgtgtgatggctggtattattggaacgatcctcttaatttcttacagtattcgccgactgataaaggcatgaggatgtggcctgcatgctgcctgatcttgcctagaaccggctgcacctgctgttctcttgtttatgcaaactggctgcacctgctattcctttgcttatgcc

SEQ ID NO: 138077 - DNA, 360 bp, Homo sapiens
  Payload ID: 7046
  Gene Symbol: GYPB
  Gene Name: glycophorin B (MNS blood group)
  Uniprot ID: P06028
  ENST ID: ENST00000513128
  CDS Start-End: 38-214
tttgcactaacttcaggaaccagctcatgatctcaggatgtatggaaaaataatctttgtattactattgtcaggagaaacgggacaacttgtccatcgtttcactgtaccagctcctgtagtgataatactcattattttgtgtgtgatggctggtattattggaacgatcctcttaatttcttacagtattcgccgactgataaaggcatgaggatgtggcctgcatgctgcctgatcttgcctagaaccggctgcacctgctgttctcttgtttatgcaaactggctgcacctgctattcctttgcttatgcccctacccctggctatcctaattccctgttctcctgcctcactat

SEQ ID NO: 138078 - DNA, 521 bp, Homo sapiens
  Payload ID: 7046
  Gene Symbol: GYPB
  Gene Name: glycophorin B (MNS blood group)
  Uniprot ID: P06028
  ENST ID: ENST00000502664
  CDS Start-End: 53-328
gtctttggtagtttttttgcactaacttcaggaaccagctcatgatctcaggatgtatggaaaaataatctttgtattactattgtcagaaattgtgagcatatcagcattaagtaccactgaggtggcaatgcacacttcaacctcttcttcagtcacaaagagttacatctcatcacagacaaatggagaaacgggacaacttgtccatcgtttcactgtaccagctcctgtagtgataatactcattattttgtgtgtgatggctggtattattggaacgatcctcttaatttcttacagtattcgccgactgataaaggcatgaggatgtggcctgcatgctgcctgatcttgcctagaaccggctgcacctgctgttctcttgtttatgcaaactggctgcacctgctattcctttgcttatgcccctacccctggctatcctaattccctgttctcctgcctcactattactgtattctctacttctaaataaaaataaaacaaaatacaaaccg

SEQ ID NO: 138079 - DNA, 1246 bp, Homo sapiens
  Payload ID: 7047
  Gene Symbol: GYPC
  Gene Name: glycophorin C (Gerbich blood group)
  Uniprot ID: P04921
  ENST ID: ENST00000259254
  CDS Start-End: 332-718
agtggcagatggaaagagaaacggttagaaaagcgtggttcttgcgcaggaaagttggagcaaagaagagttcagaagtgggcgggtgtgtgtttaaaaaaaaaaaagggggtggaaaccccaccagccaagtctgcagaaaaaaaataaatgaagtctgcctatctccgggccagagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccggggatggcctctgcctccaccacaatgcatactaccaccattgcagagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagca

SEQ ID NO: 138080 - DNA, 2067 bp, Homo sapiens
  Payload ID: 7047
  Gene Symbol: GYPC
  Gene Name: glycophorin C (Gerbich blood group)
  Uniprot ID: P04921
  ENST ID: ENST00000356887
  CDS Start-End: 1211-1534
tggcagatggaaagagaaacggttagaaaagcgtggttcttgcgcaggaaagttggagcaaagaagagttcagaagtgggcgggtgtgtgtttaaaaaaaaaaaagggggtggaaaccccaccagccaagtctgcagaaaaaaaataaatgaagtctgcctatctccgggccagagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcggaagtctccaaggacccccatgaaacacctgcatttcctgtcatgattttgaggctgaaatcatcttcctcctcccagaacacctaggtgttctagtctgaagccatcctcactctcaactcccctccttcgagccctcaccctgtgcctgaattcttccttctttgctgggacagatggacaggaggaagacaggaagtggggaaccccttcaacaactcctatggcagaggggagccataggagatgggccgggaaatgtaaagaccagcccacgcaggaaaaaaagagaactttttagcacagtgtcatctgaaaatgcaagagaagagaggctcttggtggcaacagaggagtgtgacttccagcctcagggctagcacctgacccctgctctccgtccacatctgaaaaataccactggccctgagaatccattgcaactgaggttctgcaccccaacagctgcactcaagctgccaactgaagcagagagcactgcccgcactgcagggttgtgcctgtgtgccccgctgcctccaggggtggctgccttctgccagagaatggacagctgacatcctgaggacatagagagttagtaggaatgactgtagccaatggcaaatcccatggatgaaaagccactcccaactccacaaagatgagcatagtgaaggctgcagtttagttggttcgtggttccccagaaggctttcaaacattcagcagttgtcattcagtgccaggcacccagtctaatgctgagtatagagttgtgagcaagacaagcctgaacgtgtggagcttcctgtctgagcctgatccggggatggcctctgcctccaccacaatgcatactaccaccattgcagagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagcattccg

SEQ ID NO: 138081 - DNA, 932 bp, Homo sapiens
  Payload ID: 7047
  Gene Symbol: GYPC
  Gene Name: glycophorin C (Gerbich blood group)
  Uniprot ID: P04921
  ENST ID: ENST00000409836
  CDS Start-End: 81-410
cgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaac

SEQ ID NO: 138082 - DNA, 1684 bp, Homo sapiens
  Payload ID: 7048
  Gene Symbol: GYPE
  Gene Name: glycophorin E (MNS blood group)
  Uniprot ID: P15421
  ENST ID: ENST00000358615
  CDS Start-End: 53-289
gtctttggtagtttttttgcactaacttcaggagccagctcgtgatctcaggatgtatggaaaaataatctttgtattactattgtcaggaattgtgagcatatcagcatcaagtaccactggtgtggcaatgcacacttcaacctcttcttcagtcacaaagagttacatctcatcacagacaaatgggataacactcattaattggtgggcgatggctcgtgttatttttgaggtgatgcttgttgttgttggaatgatcatcttaatttcttactgtattcgatgactgataaaggttttcatgcctctgggattgagattagaggaagaaagcaaagaaaggacatttttttacttcactgttcatggtgtaattgtgtgcctgacggctgtagctactaacttggcttacgttgactggctactaagggactctaggagtcagaaactaaatgctgagtctctcaaaggcgtagagagaatttcagagggccttaccatgacatgaggattaaactccagttctgcccgattctcatcacgaaatccttatcccatgcctcattgtgtttggtgtccccttgcctaggggacagtcctcctgggtaagatcagcaagataactcttcagtcacattccatttgatactttgaatactctgaggtccttacccaccaaatggatggaattcagctgctcaatcactgcctttctcagaactcggttgtccaaccacaattccctttcccttaggatagggctatattggcaaaatgccgcccgaacagactgctgacagtaaaccaaatattagtttctctcaccttcttgaaggcatttacagtctttgtaagcttttctcctagattttccctttcctgttcctgcttagattctaagaatgaagtgcatccttctccttttcttcattaggtgaagtgggatttacccattaccatatattcaccaccaggtcactgacgagagactccagtgaatcgctttccctctgcattcctctccttgtacagactagagggtcacattgtgtaaagcctaacatagccctgcaaagagatctggccccagcagtgaacacaaactcagtaattctctttagagtgaggtggtaatcagtgcctcttggtttcagccgtggtcctagtggctacttatggaagaataggaatagttccacaacatcctgtaacattggcttacctgtatattatatgccacccgtaaccataaaaacaccaggatttaggttccttgaaggtaatgactatgggtccctctctgtggaagaatactgaatagaagagagaaatcactcaatatgtggaatgactgatatggtttggctgtgttcccactcaaatctcatcttgaattgtagttccaataatccccacatgtcatgggaggaacccagtgggaggtacttgaatcattgcggtggtttcccctgtgctattctcatgatagtgagtaaattctcacataatctgatagttttataaaggagcttcccccttcactcagctctcattcttctccttcctgccactatgtaagaaagatgtgtttgtttcccctttggtcatgattgtaagtatcctgagaccttcccagccatgcaaaactgtagatcaataaaacctctttcctttataaatt

SEQ ID NO: 138083 - DNA, 499 bp, Homo sapiens
  Payload ID: 7048
  Gene Symbol: GYPE
  Gene Name: glycophorin E (MNS blood group)
  Uniprot ID: P15421
  ENST ID: ENST00000437468
  CDS Start-End: 57-293
agttgtctttggtagtttttttgcactaacttcaggagccagctcgtgatctcaggatgtatggaaaaataatctttgtattactattgtcaggaattgtgagcatatcagcatcaagtaccactggtgtggcaatgcacacttcaacctcttcttcagtcacaaagagttacatctcatcacagacaaatgggataacactcattaattggtgggcgatggctcgtgttatttttgaggtgatgcttgttgttgttggaatgatcatcttaatttcttactgtattcgatgactgataaaggcatgaggatgtggcctgcatgctgcctgatcttgcctagaaccagctgcacctgctgttctcttgcttatgcaaactggctgcacctgctattcctttgcttatgccccaacccttggctatcctaactccctgttctcctgcctattactgtattctctacttctaaataaaaataaaacaaaatacaaattatt

SEQ ID NO: 138084 - DNA, 1624 bp, Homo sapiens
  Payload ID: 7048
  Gene Symbol: GYPE
  Gene Name: glycophorin E (MNS blood group)
  ENST ID: ENST00000506264
  CDS Start-End: 13-192
cgtgatctcaggatgtatggaaaaataatctttgtattactattgtcaggaattgtgagcatatcagcatcaagtaccactggtgtggcaatgcacacttcaacctcttcttcagtcacaaagagttacatctcatcacagacaaatggttgtgttattggtaacataatttgctctgacaaaagcaaataaaggaaattttagacctttattattcaactggataaaactgaaggttcagaagtgattgcaaatattgccaaccaggttttcatgcctctgggattgagattagaggaagaaagcaaagaaaggacatttttttacttcactgttcatggtgtaattgtgtgcctgacggctgtagctactaacttggcttacgttgactggctactaagggactctaggagtcagaaactaaatgctgagtctctcaaaggcgtagagagaatttcagagggccttaccatgacatgaggattaaactccagttctgcccgattctcatcacgaaatccttatcccatgcctcattgtgtttggtgtccccttgcctaggggacagtcctcctgggtaagatcagcaagataactcttcagtcacattccatttgatactttgaatactctgaggtccttacccaccaaatggatggaattcagctgctcaatcactgcctttctcagaactcggttgtccaaccacaattccctttcccttaggatagggctatattggcaaaatgccgcccgaacagactgctgacagtaaaccaaatattagtttctctcaccttcttgaaggcatttacagtctttgtaagcttttctcctagattttccctttcctgttcctgcttagattctaagaatgaagtgcatccttctccttttcttcattaggtgaagtgggatttacccattaccatatattcaccaccaggtcactgacgagagactccagtgaatcgctttccctctgcattcctctccttgtacagactagagggtcacattgtgtaaagcctaacatagccctgcaaagagatctggccccagcagtgaacacaaactcagtaattctctttagagtgaggtggtaatcagtgcctcttggtttcagccgtggtcctagtggctacttatggaagaataggaatagttccacaacatcctgtaacattggcttacctgtatattatatgccacccgtaaccataaaaacaccaggatttaggttccttgaaggtaatgactatgggtccctctctgtggaagaatactgaatagaagagagaaatcactcaatatgtggaatgactgatatggtttggctgtgttcccactcaaatctcatcttgaattgtagttccaataatccccacatgtcatgggaggaacccagtgggaggtacttgaatcattgcggtggtttcccctgtgctattctcatgatagtgagtaaattctcacataatctgatagttttataaaggagcttcccccttcactcagctctcattcttctccttcctgccactatgtaagaaagatgtgtttgtttcccctttggtcatgattgtaagtatcctgagaccttcccagccatgcaaaactgtag

SEQ ID NO: 138085 - DNA, 2862 bp, Homo sapiens
  Payload ID: 7049
  Gene Symbol: GPNMB
  Gene Name: glycoprotein (transmembrane) nmb
  Uniprot ID: Q14956
  ENST ID: ENST00000258733
  CDS Start-End: 296-1978
ttgaatctagtaaatgtggaatcacaaaattgaaataatgtgcatctgaaaagtgaataaatagatgccaagaaggagtgagtcataagcacatgagttgtaagaggttgaacttgagagaccagatcaggcagtgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaa

SEQ ID NO: 138086 - DNA, 2763 bp, Homo sapiens
  Payload ID: 7049
  Gene Symbol: GPNMB
  Gene Name: glycoprotein (transmembrane) nmb
  Uniprot ID: Q14956
  ENST ID: ENST00000381990
  CDS Start-End: 162-1880
tgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaactactctaaaatcttatgattcaaacaccccaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagaca

SEQ ID NO: 138087 - DNA, 1673 bp, Homo sapiens
  Payload ID: 7049
  Gene Symbol: GPNMB
  Gene Name: glycoprotein (transmembrane) nmb
  ENST ID: ENST00000409458
  CDS Start-End: 150-770
ccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggttggcttttacaaacccctaagcttcttctttacctttccttaaaatttcaaccttctcttttcttactctataattgagaatgataacacagagagttaataacagtcaccctgctaactttccttagcatgagtgaacagtgagagataaaaatgaaatcttggttaaccttgccaaatctccaggacaccgaagagttaaaaagagagaaaaacaaaaagattaagctctttttcaaaaaaacaaaaccacttaatttttttctacctaaaaccataacaagaaaaaatgctaacacttatttatttgaatggcacatggagaccgggcatgtggctcacacttgtaatcccagcaccttggaaggcggaggcgggtggatcacctgaagtcaggagttcaagaccagcctggccaacatggtgaagtcccgtccctactaaaaatacaaaaattagccaggtgtggtggtgcgcacctgtaatcccagctactcaggaggctgaggcaggagaatcacttgaatccgggaggtggaggttgcagtgagaggagattgagccattgcactccagcctgggcaacagagtgagactccatctcgaaaaacaaacaaacaaacaaaaaacagaatggcacattgatgagcattcattgattgattctttagtttttttatgttctctaaagaatttttaagatttaaagaagcatgtgctatttatttgtaggaaatcctcagaaaaggtacaaataaaaaataaaaattatccataattaataccagagattataattgttaattattatggtgttttctttgctagtatttaagatcattattaagatcacatacacatttttgcttactatcattagcatttgatgatatgatttttttaatttttatacattgttttaatggctgcacgatatttcattgtgtacaaataaaataactactgttccgctttgaccta

SEQ ID NO: 138088 - DNA, 3406 bp, Homo sapiens
  Payload ID: 7050
  Gene Symbol: GP2
  Gene Name: glycoprotein 2 (zymogen granule membrane)
  Uniprot ID: P55259
  ENST ID: ENST00000302555
  CDS Start-End: 151-1755
gtgcaccaattgaggagagacacatgggtgggaaattgcaataaaaagacggcccacagcaggctgcattcccatggctggccagaggaggaacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgaggttatggaaaccccattgaagccagttcgtatgggctggacctggactgcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagacgctcccatgtggctgaatgggacccaccctgcccttggggatggcatcaccaaccacactgcctgtgcccattggagtggcaactgctgtttctggaaaacagaggtgctggtgaaggcctgcccaggcgggtaccatgtgtaccggttggaaggcactccctggtgtaatctgagatactgcacagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaatagaatcaaggccaagctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaagaaaagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttcactctgcttcctctgattgtttctatcatggtttccaaaaattgccatgggaacatgtcaaagggccacttttggagactctgctccaggaagaactagtccccatagctcccctatcccccaccataccacagacatgctgtgacttagagaactacacaaacatccttgggacctagatgctggaggaatgacttaatttgatgcagaaactccatcacccaagggagtacctctcactgtaaacagtgctgtgcttgctctgaaggattaagcaagaagtcccaacagaagcaatgcaccagtcctgctatgggaatgaaactgcaaagcctaggagatgggtgaagtccctttctggagacctttaatgagtacttcaaagcacccgacacagatgcagcaaatagggcatcacacatacacaggcattaatactcacgggcatatagatgctgacatgtgtacactgacttacgcccttcccacagctacagataaggcctcgcaaagttggcctcagagacacatcaggaaccaaggtggaccagcaggtgccgagcctgtgtatctgcttggaggagacgttccaatgtgctgccttgttcagagatggtgtagttgcaagaaacagaaacccaccacaatttctcaggcaaaaagggagttaattataaggacataagagcacaaagttccagtgcaagagatacatccaggctgcacaagctccgggagtggggcctggcaagccaaaagaaaccaaagtttgtcttgccttctgttcctctttctgaagccacatagccttttatgactgtgtatttttgcatcgcttttgttttctttttatgtctctgaagccagcttttcctgttcactcatcccttgattaaatatggacattctagcttcaca

SEQ ID NO: 138089 - DNA, 1975 bp, Homo sapiens
  Payload ID: 7050
  Gene Symbol: GP2
  Gene Name: glycoprotein 2 (zymogen granule membrane)
  Uniprot ID: P55259
  ENST ID: ENST00000341642
  CDS Start-End: 78-1241
atggctggccagaggaggaacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaatagaatcaaggccaagctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaagaaaagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttca

SEQ ID NO: 138090 - DNA, 2285 bp, Homo sapiens
  Payload ID: 7050
  Gene Symbol: GP2
  Gene Name: glycoprotein 2 (zymogen granule membrane)
  Uniprot ID: P55259
  ENST ID: ENST00000381360
  CDS Start-End: 379-1551
attatgaagattaaatgtgagaagtcaagaacgcaaagcagtgcccagcatgttcagcattcagcacacagcactattgtttgtaggaagcattcgcacaatgctgagacagctggaagggttgacattgtgaggggagggcccttctttcaccatcctttgcgtaaatggcttatctcacctccactcaacaagcccagtgtatggcctagaactcccatcatacctgtgcaccaattgaggagagacacatgggtgggaaattgcaataaaaagacggcccacagcaggctgcattcccatggctggccagaggaggaacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgagttccacgagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaatagaatcaaggccaagctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaagaaaagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttca

SEQ ID NO: 138091 - DNA, 2425 bp, Homo sapiens
  Payload ID: 7050
  Gene Symbol: GP2
  Gene Name: glycoprotein 2 (zymogen granule membrane)
  Uniprot ID: P55259
  ENST ID: ENST00000381362
  CDS Start-End: 78-1691
atggctggccagaggaggaacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgaggttatggaaaccccattgaagccagttcgtatgggctggacctggactgcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagacgctcccatgtggctgaatgggacccaccctgcccttggggatggcatcaccaaccacactgcctgtgcccattggagtggcaactgctgtttctggaaaacagaggtgctggtgaaggcctgcccaggcgggtaccatgtgtaccggttggaaggcactccctggtgtaatctgagatactgcacagttccacgagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaatagaatcaaggccaagctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaagaaaagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttca

SEQ ID NO: 138092 - DNA, 572 bp, Homo sapiens
  Payload ID: 7050
  Gene Symbol: GP2
  Gene Name: glycoprotein 2 (zymogen granule membrane)
  ENST ID: ENST00000575449
  CDS Start-End: 189-572
cagattctgtactaggagcaaggaacatgaggctcggtttggcatggttccacagtcacagaaatctacatccatagaggacatttcagggggctcttagcagcacccaatgcataaaactaagaaagggcagccattacttttgtgtgcagctgcatgggaagtctgcatacagcaaagtgacctgcatgcctcaccttatggaaaggatggtgggctctggcctcctgtggctggccttggtctcctgcattctgacccaggcatctgcagtgcagcgaggttatggaaaccccattgaagccagttcgtatgggctggacctggactgcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagacgctcccatgtggctgaatgggacccaccctgccctt

SEQ ID NO: 138093 - DNA, 388 bp, Homo sapiens
  Payload ID: 7050
  Gene Symbol: GP2
  Gene Name: glycoprotein 2 (zymogen granule membrane)
  ENST ID: ENST00000574982
  CDS Start-End: 1-128
tggaaaggatggtgggctctggcctcctgtggctggccttggtctcctgcattctgacccaggcatctgcagtgcagcgaggtaagtattctgctcacctggcatctcagatgtcaaggaagacctagcaagtgaggatagaagtgcagagaaggtggctcagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgc

SEQ ID NO: 138094 - DNA, 573 bp, Homo sapiens
  Payload ID: 7050
  Gene Symbol: GP2
  Gene Name: glycoprotein 2 (zymogen granule membrane)
  ENST ID: ENST00000575582
  CDS Start-End: 139-573
ctgggaaatcttgatccactggacatgctaggattctttgtttctggaaatttttagaacccagcaagtagtttggaccctggccattgtcaagtgctccagctgcatgggaagtctgcatacagcaaagtgacctgcatgcctcaccttatggaaaggatggtgggctctggcctcctgtggctggccttggtctcctgcattctgacccaggcatctgcagtgcagcgagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgcc

SEQ ID NO: 138095 - DNA, 567 bp, Homo sapiens
  Payload ID: 7050
  Gene Symbol: GP2
  Gene Name: glycoprotein 2 (zymogen granule membrane)
  ENST ID: ENST00000572478
  CDS Start-End: 78-567
atggctggccagaggaggaacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgaggggaaggaggagtaaggatgtcggagacctgtgtccaggtgcaccgatgccagacagacgctcccatgtggctgaatgggacccaccctgcccttggggatggcatcaccaaccacactgcctgtgcccattggagtggcaactgctgtttctggaaaacagaggtgctggtgaaggcctgcccaggcgggtaccatgtgtaccggttggaaggcactccctggtgtaatctgagatactgcacagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggccca

SEQ ID NO: 138096 - DNA, 580 bp, Homo sapiens
  Payload ID: 7050
  Gene Symbol: GP2
  Gene Name: glycoprotein 2 (zymogen granule membrane)
  ENST ID: ENST00000572347
  CDS Start-End: 158-580
atggctggccagaggaggaacgctttgtgttctcatcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagacgctcccatgtggctgaatgggacccaccctgcccttggggatggcatcaccaaccacactgcctgtgcccattggagtggcaactgctgtttctggaaaacagaggtgctggtgaaggcctgcccaggcgggtaccatgtgtaccggttggaaggcactccctggtgtaatctgagatactgcacagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagg

SEQ ID NO: 138097 - DNA, 2802 bp, Homo sapiens
  Payload ID: 7051
  Gene Symbol: GPA33
  Gene Name: glycoprotein A33 (transmembrane)
  Uniprot ID: Q99795
  ENST ID: ENST00000367868
  CDS Start-End: 345-1304
ctacccctttgtgagcagtctaggactttgtacacttgttaagtagggagaaggcaggggaggtggctggtttaaggggaacttgagggaagtagggaagactcctcttgggacctttggagtaggtgacacatgagcccagccccagctcacctgccaatccagctgaggagctcacctgccaatccagctgaggctgggcagaggtgggtgagaagagggaaaattgcagggacctccagttgggccaggccagaagctgctgtagctttaaccagacagctcagacctgtctggaggctgccagtgacaggttaggtttagggcagagaagaagcaagaccatggtggggaagatgtggcctgtgttgtggacactctgtgcagtcagggtgaccgtcgatgccatctctgtggaaactccgcaggacgttcttcgggcttcgcagggaaagagtgtcaccctgccctgcacctaccacacttccacctccagtcgagagggacttattcaatgggataagctcctcctcactcatacggaaagggtggtcatctggccgttttcaaacaaaaactacatccatggtgagctttataagaatcgcgtcagcatatccaacaatgctgagcagtccgatgcctccatcaccattgatcagctgaccatggctgacaacggcacctacgagtgttctgtctcgctgatgtcagacctggagggcaacaccaagtcacgtgtccgcctgttggtcctcgtgccaccctccaaaccagaatgcggcatcgagggagagaccataattgggaacaacatccagctgacctgccaatcaaaggagggctcaccaacccctcagtacagctggaagaggtacaacatcctgaatcaggagcagcccctggcccagccagcctcaggtcagcctgtctccctgaagaatatctccacagacacatcgggttactacatctgtacctccagcaatgaggaggggacgcagttctgcaacatcacggtggccgtcagatctccctccatgaacgtggccctgtatgtgggcatcgcggtgggcgtggttgcagccctcattatcattggcatcatcatctactgctgctgctgccgagggaaggacgacaacactgaagacaaggaggatgcaaggccgaaccgggaagcctatgaggagccaccagagcagctaagagaactttccagagagagggaggaggaggatgactacaggcaagaagagcagaggagcactgggcgtgaatccccggaccacctcgaccagtgacaggccagcagcagagggcggcggaggaagggttaggggttcattctcccgcttcctggcctcccttctcctttctaagccctgttctcctgtccctccatcccagacattgatggggacatttcttccccagtgtcagctgtggggaacatggctggcctggtaagggggtccctgtgctgatcctgctgacctcactgtcctgtgaagtaacccctcctggctgtgacacctggtgcgggcctggccctcactcaagaccaggctgcagcctccacttccctcgtagttggcaggagctcctggaagcacagcgctgagcatggggcgctcccactcagaactctccagggaggcgatgccagccttggggggtgggggctgtcctgctcacctgtgtgcccagcacctggaggggcaccaggtggagggtttgcactccacacatctttcttgaatgaatgaaagaataagtgagtatgcttgggccctgcattggcctggcctccagctcccactccctttccaacctcacttcccgtagctgccagtatgttccaaaccctcctgggaaggccacctcccactcctgctgcacaggccctggggagcttttgcccacacactttccatctctgcctgtcaatatcgtacctgtccctccaggcccatctcaaatcacaaggatttctctaaccctatcctaattgtccacatacgtggaaacaatcctgttactctgtcccacgtccaatcatgggccacaaggcacagtcttctgagcgagtgctctcactgtattagagcgccagctccttggggcagggcctgggcctcatggcttttgctttccctgaagccctagtagctggcgcccatcctagtgggcacttaagcttaattggggaaactgctttgattggttgtgccttcccttctctggtctccttgagatgatcgtagacacagggatgattcccacccaaacccacgtattcattcagtgagttaaacacgaattgatttaaagtgaacacacacaagggagcttgcttgcagatggtctgagttcttgtgtcctggtaattcctctccaggccagaataattggcatgtctcctcaacccacatggggttcctggttgttcctgcatcccgatacctcagccctggccctgcccagcccatttgggctctggttttctggtggggctgtcctgctgccctcccacagcctccttctgtttgtcgagcatttcttctactcttgagagctcaggcagcgttagggctgcttaggtctcatggaccagtggctggtctcacccaactgcagtttactattgctatcttttctggatgatcagaaaaataattccataaatctattgtctacttgcgattttttaaaaaatgtatatttttatatatattgttaaatcctttgcttcattccaaatgctttcagtaataataaaattgtgggtggaaattctta

SEQ ID NO: 138098 - DNA, 569 bp, Homo sapiens
  Payload ID: 7051
  Gene Symbol: GPA33
  Gene Name: glycoprotein A33 (transmembrane)
  ENST ID: ENST00000534512
  CDS Start-End: 40-285
agtgacaggttaggtttagggcagagaagaagcaagaccatggtggggaagatgtggcctgtgttgtggacactctgtgcagagcatttgggaaataaaagtacacatagaagaaatctcagattgccccacgatctcagaatccacagtcagggtgaccgtcgatgccatctctgtggaaactccgcaggacgttcttcgggcttcgcagggaaagagtgtcaccctgccctgcacctaccacacttccacctccagtcgagagggacttattcaatgggataagctcctcctcactcatacggaaagggtggtcatctggccgttttcaaacaaaaactacatccatggtgagctttataagaatcgcgtcagcatatccaacaatgctgagcagtccgatgcctccatcaccattgatcagctgaccatggctgacaacggcacctacgagtgttctgtctcgctgatgtcagacctggagggcaacaccaagtcacgtgtccgcctgttggtcctcgtgccaccctccaaaccagaatgcggcatcgagggagagaccataattg

SEQ ID NO: 138099 - DNA, 677 bp, Homo sapiens
  Payload ID: 7051
  Gene Symbol: GPA33
  Gene Name: glycoprotein A33 (transmembrane)
  ENST ID: ENST00000632571
  CDS Start-End: 479-677
tttctggtatcttccagcagctcccaacaccctttcgtcttagcctgggccttttcttcagctgcaaacacccacgagggaaatgtgcagctgacctctggggtccccgggctgagggtgatgtacgccacagtggaggaggacattggcgctgcctcaaggctgctgagcagacctgccatgaagaaaattatgagtcagggtgaccgtcgatgccatctctgtggaaactccgcaggacgttcttcgggcttcgcagggaaagagtgtcaccctgccctgcacctaccacacttccacctccagtcgagagggacttattcaatgggataagctcctcctcactcatacggaaagggtggtcatctggccgttttcaaacaaaaactacatccatggtgagctttataagaatcgcgtcagcatatccaacaatgctgagcagtccgatgcctccatcaccattgatcagctgaccatggctgacaacggcacctacgagtgttctgtctcgctgatgtcagacctggagggcaacaccaagtcacgtgtccgcctgttggtcctcgtgccaccctccaaaccagaatgcggcatcgagggagagaccataattgggaacaacatccagctgacctgccaatcaaaggagggctcaccaacccctcagtacagct

SEQ ID NO: 138100 - DNA, 747 bp, Homo sapiens
  Payload ID: 7052
  Gene Symbol: GPHA2
  Gene Name: glycoprotein hormone alpha 2
  Uniprot ID: Q96T91
  ENST ID: ENST00000279168
  CDS Start-End: 56-445
ccagcaggaggcacaggaaaactgcaagccgctctgttcctgggcctcggaagtgatgcctatggcgtcccctcaaaccctggtcctctatctgctggtcctggcagtcactgaagcctggggccaggaggcagtcatcccaggctgccacttgcaccccttcaatgtgacagtgcgaagtgaccgccaaggcacctgccagggctcccacgtggcacaggcctgtgtgggccactgtgagtccagcgccttcccttctcggtactctgtgctggtggccagtggttaccgacacaacatcacctccgtctctcagtgctgcaccatcagtggcctgaagaaggtcaaagtacagctgcagtgtgtggggagccggagggaggagctcgagatcttcacggccagggcctgccagtgtgacatgtgtcgcctctctcgctactagcccatcctctcccctccttcctcccctgggtcacagggcttgacgttctggtgggggaaacctgtgttcaagattcaaaaactggaaggagctccagccctgatggttacttgctatggaatttttttaaataaggggagggttgttccagctttgatcctttgtaagattttgtgactgtcacctgagaagaggggagtttctgcttcttccctgcctctgcctggcccttctaaaccaatctttcatcattttacttccctctttgcccttacccctaaataaagcaagcagttcttgaa

SEQ ID NO: 138101 - DNA, 466 bp, Homo sapiens
  Payload ID: 7052
  Gene Symbol: GPHA2
  Gene Name: glycoprotein hormone alpha 2
  ENST ID: ENST00000532246
  CDS Start-End: 50-406
ggaggcacaggaaaactgcaagccgctctgttcctgggcctcggaagtgatgcctatggcgtcccctcaaaccctggtcctctatctgctggtcctggcagtcactgaagcctggggccaggaggcagtcatcccaggctgccacttgcaccccttcaatgtgacagtgcgaagtgaccgccaaggcacctgccagggctcccacgtggcacaggcctgtgtgggccactgtgagtccagcgccttcccttctcggtactctgtgctggtggccagtggttaccgacacaacatcacctccgtctctcagtgctgcaccatcagtggcctgaagaaggtgaggagggcccgggcccggtggatggacgctggggtcgcgggaagaccagagagatggagatcctagacagccctgagaaaggggactgcagcacggactcccctctcccgcaggtcaaagtacagc

SEQ ID NO: 138102 - DNA, 582 bp, Homo sapiens
  Payload ID: 7052
  Gene Symbol: GPHA2
  Gene Name: glycoprotein hormone alpha 2
  Uniprot ID: Q96T91
  ENST ID: ENST00000533257
  CDS Start-End: 64-453
atttaaagaactcgccatcccacctgcacacccacgtagagacatctccccactgtgtttcagatgcctatggcgtcccctcaaaccctggtcctctatctgctggtcctggcagtcactgaagcctggggccaggaggcagtcatcccaggctgccacttgcaccccttcaatgtgacagtgcgaagtgaccgccaaggcacctgccagggctcccacgtggcacaggcctgtgtgggccactgtgagtccagcgccttcccttctcggtactctgtgctggtggccagtggttaccgacacaacatcacctccgtctctcagtgctgcaccatcagtggcctgaagaaggtcaaagtacagctgcagtgtgtggggagccggagggaggagctcgagatcttcacggccagggcctgccagtgtgacatgtgtcgcctctctcgctactagcccatcctctcccctccttcctcccctgggtcacagggcttgacgttctggtgggggaaacctgtgttcaagattcaaaaactggaaggagctccagccctgatggttacttgctatggaattttttta

SEQ ID NO: 138103 - DNA, 543 bp, Homo sapiens
  Payload ID: 7053
  Gene Symbol: GPHB5
  Gene Name: glycoprotein hormone beta 5
  Uniprot ID: Q86YW7
  ENST ID: ENST00000621500
  CDS Start-End: 58-450
tgaaatcttagtgcaagtttcagctctaaaagaagagtgggctcctgcaagattagcatgaagctggcattcctcttccttggccccatggccctcctccttctggctggctatggctgtgtcctcggtgcctccagtgggaacctgcgcacctttgtgggctgtgccgtgagggagtttactttcctggccaagaagccaggctgcaggggccttcggatcaccacggatgcctgctggggtcgctgtgagacctgggagaaacccattctggaacccccctatattgaagcccatcatcgagtctgtacctacaacgagaccaaacaggtgactgtcaagctgcccaactgtgccccgggagtcgaccccttctacacctatcccgtggccatccgctgtgactgcggagcctgctccactgccaccacggagtgtgagaccatctgaggccgctagctgctctctgcagacccacctgtgtgagcagcacatgcagttatacttcctggatgcaagactgtttaatttcgaccacaccca

SEQ ID NO: 138104 - DNA, 393 bp, Homo sapiens
  Payload ID: 7053
  Gene Symbol: GPHB5
  Gene Name: glycoprotein hormone beta 5
  Uniprot ID: Q86YW7
  ENST ID: ENST00000314140
  CDS Start-End: 1-393
atgaagctggcattcctcttccttggccccatggccctcctccttctggctggctatggctgtgtcctcggtgcctccagtgggaacctgcgcacctttgtgggctgtgccgtgagggagtttactttcctggccaagaagccaggctgcaggggccttcggatcaccacggatgcctgctggggtcgctgtgagacctgggagaaacccattctggaacccccctatattgaagcccatcatcgagtctgtacctacaacgagaccaaacaggtgactgtcaagctgcccaactgtgccccgggagtcgaccccttctacacctatcccgtggccatccgctgtgactgcggagcctgctccactgccaccacggagtgtgagaccatctga

SEQ ID NO: 138105 - DNA, 729 bp, Homo sapiens
  Payload ID: 7054
  Gene Symbol: CGA
  Gene Name: glycoprotein hormones, alpha polypeptide
  ENST ID: ENST00000369582
  CDS Start-End: 126-476
ccacagtcaaccgccctgaacacatcctgcaaaaagcccagagaaagcacttatgattgaattagaaggaagtctgtaaaatttggctgtgatcatagggagcgccatggattactacagaaaatatgcagctatctttctggtcacattgtcggtgtttctgcatgttctccattccgctcctgatgtgcagggtgcgtgaccaaatttgtgattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatca

SEQ ID NO: 138106 - DNA, 615 bp, Homo sapiens
  Payload ID: 7054
  Gene Symbol: CGA
  Gene Name: glycoprotein hormones, alpha polypeptide
  ENST ID: ENST00000610310
  CDS Start-End: 100-543
agttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggagacagggtttcaccatgttgcccaggctgctctcaaactcctgagctcaagcaatccacccactaaggcctcccaaagtgctaggattacagattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatg

SEQ ID NO: 138107 - DNA, 1010 bp, Homo sapiens
  Payload ID: 7054
  Gene Symbol: CGA
  Gene Name: glycoprotein hormones, alpha polypeptide
  Uniprot ID: P01215
  ENST ID: ENST00000627148
  CDS Start-End: 402-752
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaa

SEQ ID NO: 138108 - DNA, 587 bp, Homo sapiens
  Payload ID: 7054
  Gene Symbol: CGA
  Gene Name: glycoprotein hormones, alpha polypeptide
  ENST ID: ENST00000625577
  CDS Start-End: 401-587
gcagttactgagaactcataagacgaagctaaaatccctcttcggatccacagtcaaccgccctgaacacatcctgcaaaaagcccagagaaagtgttatataaatggaatcatatagtattcagcctgcattcagcacaattctcttgagatccattcaagctgctgtgtgtatcaatagtgtgttcatttttttgttgctggacagtattccatggtatggctataccatcatttgtatgaccattcaccttctgatggacatttgaaatgtttccaatttttggctactctaaacaaagtttctatgaatatttatatataagttttgtgtgaacatagtcttcatttctctgagataaatgcccaaaagtgcaactgttggggcatatggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatccca

SEQ ID NO: 138109 - DNA, 832 bp, Homo sapiens
  Payload ID: 7054
  Gene Symbol: CGA
  Gene Name: glycoprotein hormones, alpha polypeptide
  ENST ID: ENST00000630630
  CDS Start-End: 100-405
agttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtaagaacctcaagatccccagaagctttctaacagcccaatcagagaaatgttcatagagcccacccatggaatttaatgccaaaggtgtctaatgacccagcctctgtcgagcatttgtacaggtggggaatacatttctacccattaattaaaagagtcaattgtcttgtgggtatagactggatttattcagaatgaggagaataggggtagaggtgacaaggggcaggttgggagaaagtacagcttacttgtgctaaaaatatttcctaaaaaggagactgtgcaaatgtagtatgcatctacttatttcagcagaatgcaaacaattttatgtaatattcttcaattttgtctctatctatctatctatcatctaatctataatatgtttttttttccttcccctttaggtcacagtaatggggggtttcaaagtggagaaccacacggcgtg

SEQ ID NO: 138110 - DNA, 2501 bp, Homo sapiens
  Payload ID: 7055
  Gene Symbol: GP1BA
  Gene Name: glycoprotein Ib (platelet), alpha polypeptide
  Uniprot ID: P07359
  ENST ID: ENST00000329125
  CDS Start-End: 76-2034
gagagaaggacggagtcgagtggcaccctagaagacgctctgtgccttcggaggtctttctgcctgcctgtcctcatgcctctcctcctcttgctgctcctgctgccaagccccttacacccccaccccatctgtgaggtctccaaagtggccagccacctagaagtgaactgtgacaagaggaatctgacagcgctgcctccagacctgccgaaagacacaaccatcctccacctgagtgagaacctcctgtacaccttctccctggcaaccctgatgccttacactcgcctcactcagctgaacctagataggtgcgagctcaccaagctccaggtcgatgggacgctgccagtgctggggaccctggatctatcccacaatcagctgcaaagcctgcccttgctagggcagacactgcctgctctcaccgtcctggacgtctccttcaaccggctgacctcgctgcctcttggtgccctgcgtggtcttggcgaactccaagagctctacctgaaaggcaatgagctgaagaccctgcccccagggctcctgacgcccacacccaagctggagaagctcagtctggctaacaacaacttgactgagctccccgctgggctcctgaatgggctggagaatctcgacacccttctcctccaagagaactcgctgtatacaataccaaagggcttttttgggtcccacctcctgccttttgcttttctccacgggaacccctggttatgcaactgtgagatcctctattttcgtcgctggctgcaggacaatgctgaaaatgtctacgtatggaagcaaggtgtggacgtcaaggccatgacctctaacgtggccagtgtgcagtgtgacaattcagacaagtttcccgtctacaaatacccaggaaaggggtgccccacccttggtgatgaaggtgacacagacctatatgattactacccagaagaggacactgagggcgataaggtgcgtgccacaaggactgtggtcaagttccccaccaaagcccatacaaccccctggggtctattctactcatggtccactgcttctctagacagccaaatgccctcctccttgcatccaacacaagaatccactaaggagcagaccacattcccacctagatggaccccaaatttcacacttcacatggaatccatcacattctccaaaactccaaaatccactactgaaccaaccccaagcccgaccacctcagagcccgtcccggagcccgccccaaacatgaccaccctggagcccactccaagcccgaccaccccagagcccacctcagagcccgcccccagcccgaccaccccggagcccacctcagagcccgcccccagcccgaccaccccagagcccacctcagagcccgcccccagcccgaccaccccggagcccaccccaatcccgaccatcgccacaagcccgaccatcctggtgtctgccacaagcctgatcactccaaaaagcacatttttaactaccacaaaacccgtatcactcttagaatccaccaaaaaaaccatccctgaacttgatcagccaccaaagctccgtggggtgctccaagggcatttggagagctccagaaatgacccttttctccaccccgacttttgctgcctcctccccctgggcttctatgtcttgggtctcttctggctgctctttgcctctgtggtcctcatcctgctgctgagctgggttgggcatgtgaaaccacaggccctggactctggccaaggtgctgctctgaccacagccacacaaaccacacacctggagctgcagaggggacggcaagtgacagtgccccgggcctggctgctcttccttcgaggttcgcttcccactttccgctccagcctcttcctgtgggtacggcctaatggccgtgtggggcctctagtggcaggaaggaggccctcagctctgagtcagggtcgtggtcaggacctgctgagcacagtgagcattaggtactctggccacagcctctgagggtgggaggtttggggaccttgagagaagagcctgtgggctctcctattggaatctagttgggggttggaggggtaaggaacacagggtgatagggaggggtcttagttcctttttctgtatcagaagccctgtcttcacaacacaggcacacaatttcagtcccagccaaagcagaaggggtaatgacatggacttggcggggggacaagacaaagctcccgatgctgcatggggcgctgccagatctcacggtgaaccattttggcagaatacagcatggttcccacatgcatctatgcacagaagaaaatctggaaagtgatttatcaggatgtgagcactcgttgtgtctggatgttacaaatatgggtggttttattttctttttccctgtttagcattttctagttttccactattattgtatattatctgtataataaaaaataattttagggttggga

SEQ ID NO: 138111 - DNA, 2339 bp, Homo sapiens
  Payload ID: 7055
  Gene Symbol: GP1BA
  Gene Name: glycoprotein Ib (platelet), alpha polypeptide
  ENST ID: ENST00000611961
  CDS Start-End: 43-1923
gacgctctgtgccttcggaggtctttctgcctgcctgtcctcatgcctctcctcctcttgctgctcctgctgccaagccccttacacccccaccccatctgtgaggtctccaaagtggccagccacctagaagtgaactgtgacaagaggaatctgacagcgctgcctccagacctgccgaaagacacaaccatcctccacctgagtgagaacctcctgtacaccttctccctggcaaccctgatgccttacactcgcctcactcagctgaacctagataggtgcgagctcaccaagctccaggtcgatgggacgctgccagtgctggggaccctggatctatcccacaatcagctgcaaagcctgcccttgctagggcagacactgcctgctctcaccgtcctggacgtctccttcaaccggctgacctcgctgcctcttggtgccctgcgtggtcttggcgaactccaagagctctacctgaaaggcaatgagctgaagaccctgcccccagggctcctgacgcccacacccaagctggagaagctcagtctggctaacaacaacttgactgagctccccgctgggctcctgaatgggctggagaatctcgacacccttctcctccaagagaactcgctgtatacaataccaaagggcttttttgggtcccacctcctgccttttgcttttctccacgggaacccctggttatgcaactgtgagatcctctattttcgtcgctggctgcaggacaatgctgaaaatgtctacgtatggaagcaaggtgtggacgtcaaggccatgacctctaacgtggccagtgtgcagtgtgacaattcagacaagtttcccgtctacaaatacccaggaaaggggtgccccacccttggtgatgaaggtgacacagacctatatgattactacccagaagaggacactgagggcgataaggtgcgtgccacaaggactgtggtcaagttccccaccaaagcccatacaaccccctggggtctattctactcatggtccactgcttctctagacagccaaatgccctcctccttgcatccaacacaagaatccactaaggagcagaccacattcccacctagatggaccccaaatttcacacttcacatggaatccatcacattctccaaaactccaaaatccactactgaaccaaccccaagcccgaccacctcagagcccgtcccggagcccgccccaaacatgaccaccctggagcccactccaagcccgaccaccccagagcccacctcagagcccgcccccagcccgaccaccccggagcccaccccaatcccgaccatcgccacaagcccgaccatcctggtgtctgccacaagcctgatcactccaaaaagcacatttttaactaccacaaaacccgtatcactcttagaatccaccaaaaaaaccatccctgaacttgatcagccaccaaagctccgtggggtgctccaagggcatttggagagctccagaaatgacccttttctccaccccgacttttgctgcctcctccccctgggcttctatgtcttgggtctcttctggctgctctttgcctctgtggtcctcatcctgctgctgagctgggttgggcatgtgaaaccacaggccctggactctggccaaggtgctgctctgaccacagccacacaaaccacacacctggagctgcagaggggacggcaagtgacagtgccccgggcctggctgctcttccttcgaggttcgcttcccactttccgctccagcctcttcctgtgggtacggcctaatggccgtgtggggcctctagtggcaggaaggaggccctcagctctgagtcagggtcgtggtcaggacctgctgagcacagtgagcattaggtactctggccacagcctctgagggtgggaggtttggggaccttgagagaagagcctgtgggctctcctattggaatctagttgggggttggaggggtaaggaacacagggtgatagggaggggtcttagttcctttttctgtatcagaagccctgtcttcacaacacaggcacacaatttcagtcccagccaaagcagaaggggtaatgacatggacttggcggggggacaagacaaagctcccgatgctgcatggggcgctgccagatctcacggtgaaccattttggcagaatacagcatggttcccacatgcatctatgcacagaagaaaatctggaaagtgatttatcaggatgtgagcactcgttgtgtctggatgttacaaatatgggtggttttattttctttttccctgtttagcattttctagttttc

SEQ ID NO: 138112 - DNA, 1553 bp, Homo sapiens
  Payload ID: 7056
  Gene Symbol: GP1BB
  Gene Name: glycoprotein Ib (platelet), beta polypeptide
  Uniprot ID: P13224
  ENST ID: ENST00000366425
  CDS Start-End: 626-1246
gtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccgggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctgg

SEQ ID NO: 138113 - DNA, 2024 bp, Homo sapiens
  Payload ID: 7057
  Gene Symbol: GINM1
  Gene Name: glycoprotein integral membrane 1
  Uniprot ID: Q9NU53
  ENST ID: ENST00000367419
  CDS Start-End: 122-1114
cccgcccctccccgtctctccccgcccctccccgtccctcccgccgaagctccgtcccgcccgcgggccggctccgccctcacctcccggccgcggctgccctctgcccgggttgtccaagatggagggcgctccaccggggtcgctcgccctccggctcctgctgttcgtggcgctacccgcctccggctggctgacgacgggcgcccccgagccgccgccgctgtccggagccccacaggacggcatcagaattaatgtaactacactgaaagatgatggggacatatctaaacagcaggttgttcttaacataacctatgagagtggacaggtgtatgtaaatgacttacctgtaaatagtggtgtaacccgaataagctgtcagactttgatagtgaagaatgaaaatcttgaaaatttggaggaaaaagaatattttggaattgtcagtgtaaggattttagttcatgagtggcctatgacatctggttccagtttgcaactaattgtcattcaagaagaggtagtagagattgatggaaaacaagttcagcaaaaggatgtcactgaaattgatattttagttaagaaccggggagtactcagacattcaaactataccctccctttggaagaaagcatgctctactctatttctcgagacagtgacattttatttacccttcctaacctctccaaaaaagaaagtgttagttcactgcaaaccactagccagtatcttatcaggaatgtggaaaccactgtagatgaagatgttttacctggcaagttacctgaaactcctctcagagcagagccgccatcttcatataaggtaatgtgtcagtggatggaaaagtttagaaaagatctgtgtaggttctggagcaacgttttcccagtattctttcagtttttgaacatcatggtggttggaattacaggagcagctgtggtaataaccatcttaaaggtgtttttcccagtttctgaatacaaaggaattcttcagttggataaagtggacgtcatacctgtgacagctatcaacttatatccagatggtccagagaaaagagctgaaaaccttgaagataaaacatgtatttaaaacgccatctcatatcatggactccgaagtagcctgttgcctccaaatttgccacttgaatataattttctttaaatcgttaagaatcagtttatacactagagaaattgctaaactctaagactgcctgaaaattgacctttacagtgccaagttaaagtttaccttattctcggccgggtgcagtggctcatgcctgtaatcccaggactttgggaggccaatgcgggcggatcacgaggtcagatcaagaccatcctgccaacatggtgaaaccctgtctctactaaaaaaaataaaaaaattagctgggtgtggcggtgcacgcctgtagtcccagctacttgggaggctgaggcaggagaattgcttgaacccgggaggcggaggctgcagtgagccaagatcacgccactgcactccagcctgggtgacagagcgagactctgtttcaaaaaaaaaaaagttgaccttattctctaaaagggctggctattcatatgatgaattgttaaggaaaacttaaagtggaagagaacacatgtgaagagactttgaaattatcaaaagaaaaaaaaaagaccagacaaaatctcatgtgccaataacttttcaaggtgcctttgttaaggaaattatatccacttaattactataatatataagactttatgaaaagcactttataaaattctaatttaaaaggtcaagaacttaacacttatttttttattcagtacagtgtgcctttatattaagtatgtgactcagtataaaatcactgaagtgtatcatgatttgattgtatcctgtaccaagactacttaccttgaatgctccaagatttaaaagtagtatgacatgttctcactctaaaataaactttttttttttttttttgaggaaaaaa

SEQ ID NO: 138114 - DNA, 563 bp, Homo sapiens
  Payload ID: 7057
  Gene Symbol: GINM1
  Gene Name: glycoprotein integral membrane 1
  ENST ID: ENST00000433539
  CDS Start-End: 1-378
ttgcaactaattgtcattcaagaagaggtagtagagattgatggaaaacaagttcagcaaaaggatgtcactgaaattgatattttagttaagaaccggggagtactcagacattcaaactataccctccctttggaagaaagcatgctctactctatttctcgagacagtgacattttatttacccttcctaacctctccaaaaaagaaagtgttagttcactgcaaaccactagccagtatcttatcaggaatgtggaaaccactgtagatgaagatgttttacctggcaagttacctgaaactcctctcagagcagagccgccatcttcatataaggtactggaaacagttgactctgctccatttcgtttataatggactagcctaacgaatctcttgtcaattagcaattattttcacttgatttgtagttagaaaacaatataaataattttacaggctattaacatttttgtgcttgtattgttagaacataatttttaaagttgtaagtaacttcattgaggtacattctaaaataaaatcaccatttaaaatat

SEQ ID NO: 138115 - DNA, 889 bp, Homo sapiens
  Payload ID: 7058
  Gene Symbol: GP9
  Gene Name: glycoprotein IX (platelet)
  Uniprot ID: P14770
  ENST ID: ENST00000307395
  CDS Start-End: 223-756
cagctgtatcccatagagttgccacccaggcctcagccaggacctttcaggccagacaggagcacctgaccaaaggcttcacagccgccctcaccgcccggccttctacggtgtccagagacagttagccaggcctgggctgggcacactccaccttccctagtcaccagctggtttcccagaggagaaggctgagacccgagaagggagccagcctgtcccatgcctgcctggggagccctgttcctgctctgggccacagcagaggccaccaaggactgccccagcccatgtacctgccgcgccctggaaaccatggggctgtgggtggactgcaggggccacggactcacggccctgcctgccctgccggcccgcacccgccaccttctgctggccaacaacagccttcagtccgtgcccccgggagcctttgaccacctgccccagctgcagaccctcgatgtgacgcagaacccctggcactgtgactgcagcctcacctatctgcgcctctggctggaggaccgcacgcccgaggccctgctgcaggtccgctgtgccagccccagcctcgctgcccatggcccgctgggccggctgacaggctaccagctgggcagctgtggctggcagctgcaggcgtcctgggtgcgcccgggggtcttgtgggacgtggcgctggtcgccgtggccgcgctgggcctggctcttctggctggcctgctgtgtgccaccacagaggccctggattgagccaggcccccagaacccctggctccaggccagggggccagtccctgaggcaggtccccagactccaccaagcctggtcagcccaaaccaccagaagcccagaataaactggcagctcagctgttttatataa

SEQ ID NO: 138116 - DNA, 2854 bp, Homo sapiens
  Payload ID: 7059
  Gene Symbol: GPM6A
  Gene Name: glycoprotein M6A
  Uniprot ID: P51674
  ENST ID: ENST00000280187
  CDS Start-End: 47-883
gagaagcaggacctcgggccatggattctactgaagaaaggtagccatggaagagaatatggaagagggacagacacaaaaagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtggagggagcaaatctctgcttggaccttcgtcagtttggaattgtgacaattggagaggaaaagaaaatttgtactgtctctgagaatttcttgaggatgtgcgaatctactgagctgaacatgaccttccacttgtttattgtggcacttgctggagctggggcagcagtcattgctatggttcactaccttatggttctgtctgccaactgggcctatgtgaaagacgcctgccggatgcagaagtatgaagacatcaagtcgaaggaagagcaagagcttcatgacatccactctactcgctccaaagagcggctcaatgcatacacataaatgcatcttcctgttctttctaccatttgaatgcattggtgtttaactaagggccatccaaccatccaacctttaaaaaacaaaacgaaagtgcttctcatcaatgatatgtaaggtgacttatgaatcacctgagtacaattctttgttgtttagcacttaaatttcccaatttattaaattgatgtaaatcagatcttttctacaagctcctatccagccttttttttgaaatttctcaaactcatttactagttctgtaaaatcaaagatactaacattgtcaaatgcaaagatttgtttgatttttaaccacttcccatgtgttatacataacaccttttgcattatttcttatgttttgaaaagaaaatagctttttatactttttagttttgatttcggtaactagtttaactacaggtaaccttcaaagggaccattgtacattatgaacaatagatagagattacatcttgatgactcttgaaatatggaaattttgtctgaagatcagtggccatattactgtaggccctggttcatgttttcatcaatctaaggtgcaatttctaaatttgtaagagtaggtttaaaaaaaaaagtgcttcttatctttgttaacattgtacttttccttgatgttcttaaaaggtatttccctcagattactcatgtttatgttgtgagcatgtagaaacagtaatgctaatgcatggctagttgcctttttaagattgtgacaccaggcttaccttttaaagtttagtatatagagacaattttaatggaaataactactgtagactattgaagaatgatctctttgtgatttaagaagtggctggattggaacttttaatatgctaatgtggaaaattaattacctttatgaaggtggtttattacaaataagcacactaacccctcggaagttgttttacctactttaaaagttttaatggattgcacctctgtaaactattcctaaaatgtgtatgatatatttgaaaaggcttccattaatataatagctttgcttgcagccttccaatctatgttggtttacctgtagtgttttataaagtgtggtcagaggcccctatagaatgtattgtttgaaagtgtagtgatatatttgtgtttttatttcaagtaagtcattttaaccgaatgttcattcatattcatttataaaaagtacctgtatcaaaggaattttaacaaagagcaatcagtattattggaccaaatttggtgtttgttttcaccttgacgctcttcttttcattatttctaatgctacaagaatgctgtaaagtgtcttctaaaatgatgtagcctgacaagacatttttttcagtgtataaaactaggtagtattgtgcactgatttgaccattgtgaaatcctttctcagtgtaactgcatttctaataaaaatttattgagtgaaacaatctttgtacaatgactagtcatgcatcatcagtaattttacaagttcttgtagtaggtagggggtactactagggatatctgtggcatgattatgcattccgtagtattatttaattaatttggggttcattttgcttccttttctttatgcttagattatcttactggttcaacatttttctgatatatgcagtattacagatattcagcaaaagtattaatgggcttctttaaattctatattatagtatttcagttccgtgtcttaacagtttgtgataatttctaaaactgtcttttcaacttatgtaatgatgttgacacttttggcttttatttctggtattagagtttgtattttcacagagtgctttgtagcaggcattacaattaatctgttttgtacataaatgtgccaacagcttgatggtggcgtttttgaaatgtagaacagagtgcttgcaaaatgtaataaatacacttgtgtactttgtgtacttattattagct

SEQ ID NO: 138117 - DNA, 2821 bp, Homo sapiens
  Payload ID: 7059
  Gene Symbol: GPM6A
  Gene Name: glycoprotein M6A
  Uniprot ID: P51674
  ENST ID: ENST00000393658
  CDS Start-End: 525-1361
actctggaatgaaggggggaattacgggttggtggtcggcttcatgttaggaggacacccctccatctgttcacagctcagcctgtttccaatttaaagcccagatttcaatacaaacctcaatttcttttccccattttaaatgcaaagcaagacttgtgaatcatagtgtctctgctcctgggattcagaccaaatttccccccaaaattctcaggctatttgtttgaatacctgcttacagtggtacacaatgggcagctttgagaagaaaaattgataatcttcacggaagagtaatttgaatgaaattacacttgacagcctgtctccaagcaaacaagaggaacgagggagcctgagctaagctctgaggacttgcccaagccactgctgttggagcttcccaggaaaaaaaaaaaaaaaaaaaaaaaaaaaaaaaaaaaaaaacccccagtttttccaacatctaattgagcttttgattaattccgtgtaccagattctactgaagaaaggtagccatggaagagaatatggaagagggacagacacaaaaagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtggagggagcaaatctctgcttggaccttcgtcagtttggaattgtgacaattggagaggaaaagaaaatttgtactgtctctgagaatttcttgaggatgtgcgaatctactgagctgaacatgaccttccacttgtttattgtggcacttgctggagctggggcagcagtcattgctatggttcactaccttatggttctgtctgccaactgggcctatgtgaaagacgcctgccggatgcagaagtatgaagacatcaagtcgaaggaagagcaagagcttcatgacatccactctactcgctccaaagagcggctcaatgcatacacataaatgcatcttcctgttctttctaccatttgaatgcattggtgtttaactaagggccatccaaccatccaacctttaaaaaacaaaacgaaagtgcttctcatcaatgatatgtaaggtgacttatgaatcacctgagtacaattctttgttgtttagcacttaaatttcccaatttattaaattgatgtaaatcagatcttttctacaagctcctatccagccttttttttgaaatttctcaaactcatttactagttctgtaaaatcaaagatactaacattgtcaaatgcaaagatttgtttgatttttaaccacttcccatgtgttatacataacaccttttgcattatttcttatgttttgaaaagaaaatagctttttatactttttagttttgatttcggtaactagtttaactacaggtaaccttcaaagggaccattgtacattatgaacaatagatagagattacatcttgatgactcttgaaatatggaaattttgtctgaagatcagtggccatattactgtaggccctggttcatgttttcatcaatctaaggtgcaatttctaaatttgtaagagtaggtttaaaaaaaaaagtgcttcttatctttgttaacattgtacttttccttgatgttcttaaaaggtatttccctcagattactcatgtttatgttgtgagcatgtagaaacagtaatgctaatgcatggctagttgcctttttaagattgtgacaccaggcttaccttttaaagtttagtatatagagacaattttaatggaaataactactgtagactattgaagaatgatctctttgtgatttaagaagtggctggattggaacttttaatatgctaatgtggaaaattaattacctttatgaaggtggtttattacaaataagcacactaacccctcggaagttgttttacctactttaaaagttttaatggattgcacctctgtaaactattcctaaaatgtgtatgatatatttgaaaaggcttccattaatataatagctttgcttgcagccttccaatctatgttggtttacctgtagtgttttataaagtgtggtcagaggcccctatagaatgtattgtttgaaagtgtagtgatatatttgtgtttttatttcaagtaagtcattttaaccgaatgttcattcatattcatttataaaaagtacctgtatcaaaggaattttaacaaagagcaatcagtattattggaccaaatttggtgtttgttttcaccttgacgctcttcttttcattatttctaatgctacaagaatgctgtaaagtgtcttctaaaatgatgtagcctgacaagacatttttttcagtgtataaaactaggtagtattgtgcactgatttgaccattgtgaaatcctttctcagtgtaactgcatttctaataaaaatttattgagtgaaacaa

SEQ ID NO: 138118 - DNA, 579 bp, Homo sapiens
  Payload ID: 7059
  Gene Symbol: GPM6A
  Gene Name: glycoprotein M6A
  ENST ID: ENST00000513667
  CDS Start-End: 284-579
gaggcagcaggtgttctgtaagacagaccaggaagaggtagtaaggcagccagaaagctaccatggtacaccagagaagccaaattattcttgaggtacccactgagcttgtcagctgcaatggctaagagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctg

SEQ ID NO: 138119 - DNA, 568 bp, Homo sapiens
  Payload ID: 7059
  Gene Symbol: GPM6A
  Gene Name: glycoprotein M6A
  ENST ID: ENST00000507540
  CDS Start-End: 445-568
aaaagagcaatgcagtttttaagaggcagttcaaattctcaccaccttcttttctctcttacagcttctcaaggaataactactgtcctgaaattagaatgacttttttctgtatgtttctgttttaattacttattctggttaatgcctcctaacaaagatcatcaggaaatctgtatttgaataagttcggtacatttcgatgatggagaatgcacatcataagaaagcgtggagcacctcagtaagagggtgttagaaaggatttattacagatttggacttgcattagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttct

SEQ ID NO: 138120 - DNA, 2614 bp, Homo sapiens
  Payload ID: 7059
  Gene Symbol: GPM6A
  Gene Name: glycoprotein M6A
  Uniprot ID: P51674
  ENST ID: ENST00000506894
  CDS Start-End: 353-1156
gggtgctgagacaacgtgtgtgtctgtaatgtgcattcaatgtatttaggagagagactttgcacgtgtctctaatgaaagtgaaagggggcagggtgggggcctctggggaggagacccacagtgaaggggaggaaaacgggcttctcgcagaggaggcaggtggaaagagggaggggtctgtgcgcccgcagagtcgccaggcgccctgcgagttgtctccgctgggaggggcgaggctgtcacttgccagggcgcgaggagcctcagcgcggcttggagaacttggccccgcgcagcgtctggtcactcgctctcctctggggactgcagagaagcaggacctcgggccatggggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtggagggagcaaatctctgcttggaccttcgtcagtttggaattgtgacaattggagaggaaaagaaaatttgtactgtctctgagaatttcttgaggatgtgcgaatctactgagctgaacatgaccttccacttgtttattgtggcacttgctggagctggggcagcagtcattgctatggttcactaccttatggttctgtctgccaactgggcctatgtgaaagacgcctgccggatgcagaagtatgaagacatcaagtcgaaggaagagcaagagcttcatgacatccactctactcgctccaaagagcggctcaatgcatacacataaatgcatcttcctgttctttctaccatttgaatgcattggtgtttaactaagggccatccaaccatccaacctttaaaaaacaaaacgaaagtgcttctcatcaatgatatgtaaggtgacttatgaatcacctgagtacaattctttgttgtttagcacttaaatttcccaatttattaaattgatgtaaatcagatcttttctacaagctcctatccagccttttttttgaaatttctcaaactcatttactagttctgtaaaatcaaagatactaacattgtcaaatgcaaagatttgtttgatttttaaccacttcccatgtgttatacataacaccttttgcattatttcttatgttttgaaaagaaaatagctttttatactttttagttttgatttcggtaactagtttaactacaggtaaccttcaaagggaccattgtacattatgaacaatagatagagattacatcttgatgactcttgaaatatggaaattttgtctgaagatcagtggccatattactgtaggccctggttcatgttttcatcaatctaaggtgcaatttctaaatttgtaagagtaggtttaaaaaaaaaagtgcttcttatctttgttaacattgtacttttccttgatgttcttaaaaggtatttccctcagattactcatgtttatgttgtgagcatgtagaaacagtaatgctaatgcatggctagttgcctttttaagattgtgacaccaggcttaccttttaaagtttagtatatagagacaattttaatggaaataactactgtagactattgaagaatgatctctttgtgatttaagaagtggctggattggaacttttaatatgctaatgtggaaaattaattacctttatgaaggtggtttattacaaataagcacactaacccctcggaagttgttttacctactttaaaagttttaatggattgcacctctgtaaactattcctaaaatgtgtatgatatatttgaaaaggcttccattaatataatagctttgcttgcagccttccaatctatgttggtttacctgtagtgttttataaagtgtggtcagaggcccctatagaatgtattgtttgaaagtgtagtgatatatttgtgtttttatttcaagtaagtcattttaaccgaatgttcattcatattcatttataaaaagtacctgtatcaaaggaattttaacaaagagcaatcagtattattggaccaaatttggtgtttgttttcaccttgacgctcttcttttcattatttctaatgctacaagaatgctgtaaagtgtcttctaaaatgatgtagcctgacaagacatttttttcagtgtataaaactaggtagtattgtgcactgatttgaccattgtgaaatcctttctcagtgtaactgcatttctaataaaaatttattgagtgaaac

SEQ ID NO: 138121 - DNA, 551 bp, Homo sapiens
  Payload ID: 7059
  Gene Symbol: GPM6A
  Gene Name: glycoprotein M6A
  ENST ID: ENST00000509865
  CDS Start-End: 403-551
atctctgtaccgcaccctgtgttcttcagttgggaaaaaaaagggtctgtcggtatcgagtgatgcctacacttgaatgcagtagtgacttctgaactcctatatgctggccaaaaaaagaaaatcagttttattttgatttttgttgaatgaacattcttctttaaaagtaatctaaagatcatgtctacagaagctgagtgatcatagttcctgctctattagccattcatctggagaaacaaatgagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatct

SEQ ID NO: 138122 - DNA, 737 bp, Homo sapiens
  Payload ID: 7059
  Gene Symbol: GPM6A
  Gene Name: glycoprotein M6A
  ENST ID: ENST00000503397
  CDS Start-End: 83-737
aagcacaggctctggcgtccatctctgtaccgcaccctgtgttcttcagttgggaaaaaaaagggtctgtcggtatcgagtgatgcctacacttgggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtggagggagcaaatctctgcttggaccttcgtcagtttggaattgtgacaattggagaggaaaagaaaatttgtactgtctctgagaatttcttgaggatgtgcgaatctactgagctgaacatgaccttccacttgtttattgtggcacttgctggagctggggcagcagtcattg

SEQ ID NO: 138123 - DNA, 734 bp, Homo sapiens
  Payload ID: 7059
  Gene Symbol: GPM6A
  Gene Name: glycoprotein M6A
  ENST ID: ENST00000513365
  CDS Start-End: 348-734
agcaggtgttctgtaagacagaccaggaagaggtagtaaggcagccagaaagctaccatggtacaccagagaagccaaattattcttgaggtacccactgagcttgtcagctgcaatggctaagagtggctgataatgttccttacttctgtagctgagatttcccaacttaatttgggttctcatcagggtagaattccatccaagtcaatcgcagcatctgcacccacagctctgagaagggaaagatgtgcttggtggtggccccaagtttgcagtatcggattggactcattagaattacaaggaaatgaaataaagaaagattctactgaagaaaggtagccatggaagagaatatggaagagggacagacacaaaaagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttgg

SEQ ID NO: 138124 - DNA, 1500 bp, Homo sapiens
  Payload ID: 7059
  Gene Symbol: GPM6A
  Gene Name: glycoprotein M6A
  Uniprot ID: P51674
  ENST ID: ENST00000515090
  CDS Start-End: 326-1141
gcatatattaaatttgtctgactaggaagagttatgtcagtaaagcaattagatacatgggttgtgatttggggaaaaaagctgaattagaaatctgtacttgtaaatcatcaacaagtatgtaatcattggtgatgttgatactgatgaaatcaacctaaaggtggaacaaaaaggaccaaaaatagtgacttaaaaaaacaatttagaaaaaatctcagaacacgaaacagaatgttaaattgtcacaggagagagcttatgcccttgaatcaagggaaaatagagttcacaaggagccagcggccggcagcatcacacttttatgacagacctggaagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtggagggagcaaatctctgcttggaccttcgtcagtttggaattgtgacaattggagaggaaaagaaaatttgtactgtctctgagaatttcttgaggatgtgcgaatctactgagctgaacatgaccttccacttgtttattgtggcacttgctggagctggggcagcagtcattgctatggttcactaccttatggttctgtctgccaactgggcctatgtgaaagacgcctgccggatgcagaagtatgaagacatcaagtcgaaggaagagcaagagcttcatgacatccactctactcgctccaaagagcggctcaatgcatacacataaatgcatcttcctgttctttctaccatttgaatgcattggtgtttaactaagggccatccaaccatccaacctttaaaaaacaaaacgaaagtgcttctcatcaatgatatgtaaggtgacttatgaatcacctgagtacaattctttgttgtttagcacttaaatttcccaatttattaaattgatgtaaatcagatcttttctacaagctcctatccagccttttttttgaaatttctcaaactcatttactagttctgtaaaatcaaagatactaacattgtcaaatgcaaagatttgtttgatttttaaccacttcccatgtgttatacataacaccttttgcattatttcttatg

SEQ ID NO: 138125 - DNA, 566 bp, Homo sapiens
  Payload ID: 7059
  Gene Symbol: GPM6A
  Gene Name: glycoprotein M6A
  ENST ID: ENST00000507520
  CDS Start-End: 251-566
tcacaaggagccagcggccggcagcatcacacttttatgacagacctggaagaataaagtttagccttgttcctcgaactcaaagaaagaaagtttggggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtgg

SEQ ID NO: 138126 - DNA, 561 bp, Homo sapiens
  Payload ID: 7059
  Gene Symbol: GPM6A
  Gene Name: glycoprotein M6A
  ENST ID: ENST00000505375
  CDS Start-End: 316-561
aattccgtgtaccagattctactgaagaaaggtagccatggaagagaatatggaagagggacagacacaaaaagggcatccaaacagaccacctgggattcctcagtccgcttgggcctctgatagaagcatttgtgtgcttgtatgatcttattttcgcacgggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacg

SEQ ID NO: 138127 - DNA, 566 bp, Homo sapiens
  Payload ID: 7059
  Gene Symbol: GPM6A
  Gene Name: glycoprotein M6A
  ENST ID: ENST00000512509
  CDS Start-End: 306-566
actcgctctcctctggggactgcagagaagcaggacctcgggccatggaatgcagtagtgacttctgaactcctatatgctggccaaaaaaagaaaatcagttttattttgatttttgttgaatgaacattcttctttaaaagtaatctaaagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtttcattatgctgacatatcttttcatgttggcctggctgggagtcacggctttcacctcactgccagtttacatg

SEQ ID NO: 138128 - DNA, 690 bp, Homo sapiens
  Payload ID: 7059
  Gene Symbol: GPM6A
  Gene Name: glycoprotein M6A
  ENST ID: ENST00000505561
  CDS Start-End: 423-690
aagtcgtgaattgaatccaaaaagatgaattggttcaattggccttctttcttgagaacggggaaaagatgactctcagtatgctctgaggatctctttatcccacggcaaattttaataataactatgctgccccatctttcagctactctgggtgaatctctattctttgcaatcgaaagacctctaagtaaaacaaatcttcagatccttttaggagtcttacataaagaggcttactgctaagaaattttccctgagtttaacctgggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagttt

SEQ ID NO: 138129 - DNA, 550 bp, Homo sapiens
  Payload ID: 7059
  Gene Symbol: GPM6A
  Gene Name: glycoprotein M6A
  ENST ID: ENST00000505304
  CDS Start-End: 352-550
aaatctgaaataaaggatgagaagagtgtagatggaaaaaatggggaagaaaagatgaaacaatggaaaagtgtaattttcataacttaaaacttcaaagtatatatgtatgacttttttcgtcttcatgagattgatttgttcattcattcaacatttaataaatatataacaagcacccagtgtgggccagctgtagtcaaattgctgggaagatagcaattaaaaacaagctaacaagccaaaaccagccttcatggagcctatattctgtaaggagagagcttatgcccttgaatcaagggaaaatagagttcacaaggagccagcggccggcagcatcacacttttatgacagacctggaagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatg

SEQ ID NO: 138130 - DNA, 584 bp, Homo sapiens
  Payload ID: 7059
  Gene Symbol: GPM6A
  Gene Name: glycoprotein M6A
  ENST ID: ENST00000512897
  CDS Start-End: 454-584
gagaagcgaggtgctagcaaaatcaaatctgaaataaaggatgagaagagtgtagatggaaaaaatggggaagaaaagatgaaacaatggaaaagtgtaattttcataacttaaaacttcaaagtatatatgtatgacttttttcgtcttcatgagattgatttgttcattcattcaacatttaataaatatataacaagcacccagtgtgggccagctgtagtcaaattgctgggaagatagcaattaaaaacaagctaacaagccaaaaccagccttcatggagcctatattctgtaagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaac

SEQ ID NO: 138131 - DNA, 555 bp, Homo sapiens
  Payload ID: 7059
  Gene Symbol: GPM6A
  Gene Name: glycoprotein M6A
  ENST ID: ENST00000503563
  CDS Start-End: 525-555
agttgggattgagattggaaaagagcacaattaaaactagaggactctcatgggaacaagtagtcctcttgggtgtatgcatgtgtacgtgaatctgattggaggtggaagaatggcatgtaggagagaaaaaccagtgttctgaggcagcaggtgttctgtaagacagaccaggaagaggtagtaaggcagccagaaagctaccatggtacaccagagaagccaaattattcttgaggtacccactgagcttgtcagctgcaatggctaagagcttctcaaggaataactactgtcctgaaattagaatgacttttttctgtatgtttctgttttaattacttattctggttaatgcctcctaacaaagatcatcaggaaatctgtatttgaataagttcggtacatttcgatgatggagaatgcacatcataagaaagcgtggagcacctcagtaagagggtgttagaaaggatttattacagatttggacttgcattagattctactgaagaaaggtagccatggaagagaatatggaagagggacagacac

SEQ ID NO: 138132 - DNA, 616 bp, Homo sapiens
  Payload ID: 7059
  Gene Symbol: GPM6A
  Gene Name: glycoprotein M6A
  ENST ID: ENST00000502754
  CDS Start-End: 265-616
gaacaatgtactcagctgcatgccccagcagtaagacagcgtgtgtcaggccaaggaaataactgtttccaccctcccaaaagcaagagatcccatcactgactttcacaagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtggagggagcaaatctctgcttggaccttcgtcagtttg

SEQ ID NO: 138133 - DNA, 579 bp, Homo sapiens
  Payload ID: 7059
  Gene Symbol: GPM6A
  Gene Name: glycoprotein M6A
  ENST ID: ENST00000512610
  CDS Start-End: 221-579
acataaatttcggcattgcttacatattaatccttgggttcctaggctggcattggagaaactttactggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtggagggagcaaatctctgcttggaccttcgtcagtttggtaagtg

SEQ ID NO: 138134 - DNA, 3275 bp, Homo sapiens
  Payload ID: 7060
  Gene Symbol: GPM6B
  Gene Name: glycoprotein M6B
  Uniprot ID: Q13491
  ENST ID: ENST00000316715
  CDS Start-End: 439-1425
agaagaaatgaggtggggagaaagagagagagagagagagatcgagattgagatcttaagaaagagagcaaggaggaagagcccggtggggagcaggtccttctcccccacccccctacccccaactcccactggagccgcattgagactgtaggcaccaccgggcgccgaatggctgttttctaactgggatcctcggtgacgtatggctgcctgccccttggcagctgtctttatggaccagtaggcagagcgaaattgacgctgacaagacttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaagtgaacagcagagctgaaatggaaattggcaggtaccactggatgtacccaggctcaaagaaccaccagtaccatcccgtgccaaccctgggggacagggctagccccttgagcagtccaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataatatttcatttggattctcttttttggttaatgcctaaaaatgcctatttgggatttttttttttttttaaattaagagaagctctcttctgtgtagaacagttgttccaaaatagcttagtgttttgttttcctgttgcatgacagatttaactattctttccagcagtggaggtgctgtcagagtccagtgttctagaagaggcagtgtctaaagcctaattttacttttctaattctggtagctattaccaggaatttttgaaagttttgtttaagtagtctaatattttttatgtaaagagcattaaattttgctatgtataaatttttgtaacctaacagtgaatcaatattttctatcagtgccaagggcttcctgtagttctattcaagtgttacaataaatatttgtagataatagtc

SEQ ID NO: 138135 - DNA, 1673 bp, Homo sapiens
  Payload ID: 7060
  Gene Symbol: GPM6B
  Gene Name: glycoprotein M6B
  Uniprot ID: Q13491
  ENST ID: ENST00000355135
  CDS Start-End: 166-1083
cttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaagtgaacagcagagctgaaatggaaattggcaggtaccactggatgtacccaggctcaaagaaccaccagtaccatcccgtgccaaccctgggggacagggctagccccttgagcagtccaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaa

SEQ ID NO: 138136 - DNA, 1830 bp, Homo sapiens
  Payload ID: 7060
  Gene Symbol: GPM6B
  Gene Name: glycoprotein M6B
  Uniprot ID: Q13491
  ENST ID: ENST00000356942
  CDS Start-End: 443-1240
ggctagaagaaatgaggtggggagaaagagagagagagagagagatcgagattgagatcttaagaaagagagcaaggaggaagagcccggtggggagcaggtccttctcccccacccccctacccccaactcccactggagccgcattgagactgtaggcaccaccgggcgccgaatggctgttttctaactgggatcctcggtgacgtatggctgcctgccccttggcagctgtctttatggaccagtaggcagagcgaaattgacgctgacaagacttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaa

SEQ ID NO: 138137 - DNA, 1033 bp, Homo sapiens
  Payload ID: 7060
  Gene Symbol: GPM6B
  Gene Name: glycoprotein M6B
  ENST ID: ENST00000398361
  CDS Start-End: 287-826
gctcaggtggcgcctcctcggccacctctgcgacgaagccgggacgctggaggtgggaggggcgcggcgcaggtgtccggaacgcccaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttg

SEQ ID NO: 138138 - DNA, 3957 bp, Homo sapiens
  Payload ID: 7060
  Gene Symbol: GPM6B
  Gene Name: glycoprotein M6B
  Uniprot ID: Q13491
  ENST ID: ENST00000454189
  CDS Start-End: 129-869
agcgcagcccgcagaagcccggtcagcgcacgtgcccgcgagacctgcaaacttgtgccaccggctctgcccgtccccggggagcccgaacgccccgcagccctcacccctcccgccagtctccagccatgggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaaggatttatatgtgggtagttttttttttggtacaacacaatcattctgttagagcccacaaaattggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcatcaagtgtaaagaatgatactgaggatttttacattttatgaaatgaaataatggcatttacaaaatgaaaaatgtagtttcacaactaagttttgttaacagagactgcatgctttgcttatagttcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaaagcaccctctcgtatttcatttttgctttttcttaacaatacctttggccatttttttccagttcactatgtttgtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataa

SEQ ID NO: 138139 - DNA, 558 bp, Homo sapiens
  Payload ID: 7060
  Gene Symbol: GPM6B
  Gene Name: glycoprotein M6B
  ENST ID: ENST00000493085
  CDS Start-End: 275-558
aattccaacgtgcatcaagacggaaaaccaccgtgtaactccttgcttctcaaaatgtcccaggacaaaggccccaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacggg

SEQ ID NO: 138140 - DNA, 678 bp, Homo sapiens
  Payload ID: 7060
  Gene Symbol: GPM6B
  Gene Name: glycoprotein M6B
  ENST ID: ENST00000475307
  CDS Start-End: 358-678
gaaagagagagagagagagagatcgagattgagatcttaagaaagagagcaaggaggaagagcccgactgtaggcaccaccgggcgccgaatggctgttttctaactgggatcctcggtgacgtatggctgcctgccccttggcagctgtctttatggaccagtaggcagagcgaaattgacgctgacaagacttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggca

SEQ ID NO: 138141 - DNA, 587 bp, Homo sapiens
  Payload ID: 7060
  Gene Symbol: GPM6B
  Gene Name: glycoprotein M6B
  ENST ID: ENST00000468080
  CDS Start-End: 359-587
aaccatatgcttgcctgcatctaatgtgaaaccatccctgctccatgttcttagcatcctaggttcgtttccttcttggcactcaccgtggcttgaaatcacatggatttatgtgattatttgagtatgcctttccccactaaactgtcagcttcatgaaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctaca

SEQ ID NO: 138142 - DNA, 1372 bp, Homo sapiens
  Payload ID: 7060
  Gene Symbol: GPM6B
  Gene Name: glycoprotein M6B
  ENST ID: ENST00000493677
  CDS Start-End: 282-1190
cttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaagaacatttaaatgtggaaaagatctcaacgagccatttgtgaacagcagagctgaaatggaaattggcaggtaccactggatgtacccaggctcaaagaaccaccagtaccatcccgtgccaaccctgggggacagggctagccccttgagcagtccaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttcttta

SEQ ID NO: 138143 - DNA, 3534 bp, Homo sapiens
  Payload ID: 7061
  Gene Symbol: GP5
  Gene Name: glycoprotein V (platelet)
  Uniprot ID: P40197
  ENST ID: ENST00000401815
  CDS Start-End: 73-1755
ggatcccagggttcagtacaggcgcgaacgctcctgtgtgttgaccacactcccacggttgctttttcagacatgctgagggggactctactgtgcgcggtgctcgggcttctgcgcgcccagcccttcccctgtccgccagcttgcaagtgtgtcttccgggacgccgcgcagtgctcggggggcgacgtggcgcgcatctccgcgctaggcctgcccaccaacctcacgcacatcctgctcttcggaatgggccgcggcgtcctgcagagccagagcttcagcggcatgaccgtcctgcagcgcctcatgatctccgacagccacatttccgccgttgcccccggcaccttcagtgacctgataaaactgaaaaccctgaggctgtcgcgcaacaaaatcacgcatcttccaggtgcgctgctggataagatggtgctcctggagcagttgtttttggaccacaatgcgctaaggggcattgaccaaaacatgtttcagaaactggttaacctgcaggagctcgctctgaaccagaatcagctcgatttccttcctgccagtctcttcacgaatctggagaacctgaagttgttggatttatcgggaaacaacctgacccacctgcccaaggggttgcttggagcacaggctaagctcgagagacttctgctccactcgaaccgccttgtgtctctggattcggggctgttgaacagcctgggcgccctgacggagctgcagttccaccgaaatcacatccgttccatcgcacccggggccttcgaccggctcccaaacctcagttctttgacgctttcgagaaaccaccttgcgtttctcccctctgcgctctttcttcattcgcacaatctgactctgttgactctgttcgagaacccgctggcagagctcccgggggtgctcttcggggagatggggggcctgcaggagctgtggctgaaccgcacccagctgcgcaccctgcccgccgccgccttccgcaacctgagccgcctgcggtacttaggggtgactctgagcccgcggctgagcgcgcttccgcagggcgccttccagggccttggcgagctccaggtgctcgccctgcactccaacggcctgaccgccctccccgacggcttgctgcgcggcctcggcaagctgcgccaggtgtccctgcgccgcaacaggctgcgcgccctgccccgtgccctcttccgcaatctcagcagcctggagagcgtccagctcgaccacaaccagctggagaccctgcctggcgacgtgtttggggctctgccccggctgacggaggtcctgttggggcacaactcctggcgctgcgactgtggcctggggcccttcctggggtggctgcggcagcacctaggcctcgtgggcggggaagagcccccacggtgcgcaggccctggggcgcacgccggcctgccgctctgggccctgccggggggtgacgcggagtgcccgggcccccggggcccgcctccccgccccgctgcggacagctcctcggaagcccctgtccacccagccttggctcccaacagctcagaaccctgggtgtgggcccagccggtgaccacgggcaaaggtcaagatcatagtccgttctgggggttttattttctgcttttagctgttcaggccatgatcaccgtgatcatcgtgtttgctatgattaaaattggccaactctttcgaaaattaatcagagagagagcccttgggtaaaccaatgggaaaatcttctaattacttagaacctgaccagatgtggctcggaggggaatccagacccgctgctgtcttgctctccctcccctccccactcctcctctcttcttcctcttctctctcactgccacgccttcctttccctcctcctccccctctccgctctgtgctcttcattctcacaggcccgcaacccctcctctctgtgtcccccgcccgttcctggaaactgagcttgacgtttgtaaactgtggttgcctgccttccccagctcccacgcgggtgtgcgctgacactgccgggggcgctggactgtgttggacccatccgtgctccgctgtgcctggcttggcgtctggtggagagaggggcctcttcagtgtctactgagtaaggggacagctccaggccggggcctgtctcctgcacagagtaagccggtaaatgtttgtgaaatcaatgcgtggataaaggaacacatgccatccaagtgatgatggcttttcctggagggaaaggataggctgttgctctatctaattttttgtttttgtttttggacagtctagctctgtggcccaggctggcgtgcagtgggccgtctcagttcactgcagcctccgcctcccaggttcaagtgattctcatgcctcagcgttctgagtagctgggattagaggcgtgtgccactacacccggctaatttttgtactttttaaagtagagacggggctttgccatattggcctggctgatctcaaactcctggtcttgaactcctggccacaagtgatctgcccgccttggcctcccaaagtgctgggattacaggcgtaagccactacacctggccctcttcatcgaattttatttgagaagtagagctcttgccattttttcccttgctccatttttctcactttatgtctctctgacctatgggctacttgggagagcactggactccattcatgcatgagcattttcaggataagcgacttctgtgaggctgagagaggaagaaaacacggagccttccctccaggtgcccagtgtaggtccagcgtgtttcctgagcctcctgtgagtttccacttgctttacatccatgcaacatgtcattttgaaactggattgatttgcatttcctggaactctgccacctcatttcacaagcatttatggagcagttaacatgtgactggtattcatgaatataatgataagcttgattctagttcagctgctgtcacagtctcatttgttcttccaactgaaagccgtaaaacctttgttgctttaattgaatgtctgtgcttatgagaggcagtggttaaaacaggggctggcgagttgacaactgtgggttcaaatcccagctctaccacttactaactgcatgggactttgggtaagacacctgcttacattctctaagccttggtttcctgaaccttaaaacaggataacatagtacctgcttcgtagagtttttgtgagaattaaaggcaataaagcatataatgacttagcccagcggcctgcaggcaatacatgttaatgaatgttagctattattactaaaggatgagcaattattattggcatcatgatttctaaagaagagctttgagttggtatttttctctgtgtataagggtaagtccgaactttctcagactggaggttacattcacatcagtctgtcttcccctgcggatggcctcagccctgggtggccagactctgtgctcacaatccagagcaatggatcc

SEQ ID NO: 138144 - DNA, 2268 bp, Homo sapiens
  Payload ID: 7062
  Gene Symbol: GP6
  Gene Name: glycoprotein VI (platelet)
  Uniprot ID: Q9HCN6
  ENST ID: ENST00000310373
  CDS Start-End: 29-1891
acagagctcaggacagggctgaggaaccatgtctccatccccgaccgccctcttctgtcttgggctgtgtctggggcgtgtgccagcgcagagtggaccgctccccaagccctccctccaggctctgcccagctccctggtgcccctggagaagccagtgaccctccggtgccagggacctccgggcgtggacctgtaccgcctggagaagctgagttccagcaggtaccaggatcaggcagtcctcttcatcccggccatgaagagaagtctggctggacgctaccgctgctcctaccagaacggaagcctctggtccctgcccagcgaccagctggagctcgttgccacgggagtttttgccaaaccctcgctctcagcccagcccggcccggcggtgtcgtcaggaggggacgtaaccctacagtgtcagactcggtatggctttgaccaatttgctctgtacaaggaaggggaccctgcgccctacaagaatcccgagagatggtacagggctagttttcccatcatcacggtgaccgccgcccacagcggaacctaccgatgctacagcttctccagcagggacccatacctgtggtcagcccccagcgaccccctggagcttgtggtcacaggaacctctgtgacccccagccggttaccaacagaaccaccttccccggtagcagaattctcagaagccaccgctgaactgaccgtctcattcacaaacgaagtcttcacaactgagacttctaggagtatcaccgccagtccaaaggagtcagactctccagctggtgagtcctgcccgccagtactacaccaagggcaacctggtccggatatgcctcggggctgtgatcctaataatcctggcggggtttctggcagaggactggcacagccggaggaagcgcctgcggcacaggggcagggctgtgcagaggccgcttccgcccctcccgcccctcccgctgacccggaaatcaaacgggggtcaggatggaggccgacaggatgttcacagccgcgggttatgttcatgaccgctgaaccccaggcacggtcgtatccaagggagggatcatggcatgggaggcgactcaaagactggcgtgtgtggagcgtggaagcaggagggcagaggctacagctgtggaaacgaggccatgctgcctcctcctggtgttccatcagggagccgttcggccagtgtctgtctgtctgtctgcctctctgtctgagggcaccctccatttgggatggaaggaatctgtggagaccccatcctcctccctgcacactgtggatgacatggtaccctggctggaccacatactggcctctttcttcaacctctctaatatgggctccagacggatctctaaggttcccagctctcagggttgactctgttccatcctctgtgcaaaatcctcccgtgcttccctttggccctctgtgctcttgtctggttttccccagaaactctcaccctcactccatctcccactgcggtctaacaaatctcctttcgtctctcagaacgggtcttgcaggcagtttgggtatgtcattcattttccttagtgtaaaactagcacgttgcccgcttcccttcacattagaaaacaagatcagcctgtgcaacatggtgaaacctcatctctaccaacaaaacaaaaaaacacaaaaattagccaggtgtggtggtgcatccctatactcccagcaactcagggggctgaggtgggagaatggcttgagcctgggaggcagaggttgcagtgagctgagatcacaccactgcactctagctcgggtgacgaagcctgactttgtctcaaaaaatacagggatgaatatgtcaattaccctgatttgatcatagcacgttgtatacatgtactgcaatattgctgtccaccccataaatatgtacaattctgtatacatttttaaaatcataaaaataagataatgcaccgtctccacccctctcatatttactttctgaaggaaatgttaggtcttctcaaggtaaagttctatatttattatagcgtttaggcatttcttgaccatctaatgagtgtaaaactgtaccactgggccaagtgcagtggatcatgtctgtaatcctagcactgtgggaggccaaggcaggaggatcgcttgagcccaggagttcaagaccagcctgggcaacatagtgagaccccatctctacttaaaataaagaagataaaaattgttttaaaa

SEQ ID NO: 138145 - DNA, 2210 bp, Homo sapiens
  Payload ID: 7062
  Gene Symbol: GP6
  Gene Name: glycoprotein VI (platelet)
  Uniprot ID: Q9HCN6
  ENST ID: ENST00000333884
  CDS Start-End: 29-994
acagagctcaggacagggctgaggaaccatgtctccatccccgaccgccctcttctgtcttgggctgtgtctggggcgtgtgccagcgcagagtggaccgctccccaagccctccctccaggctctgcccagctccctggtgcccctggagaagccagtgaccctccggtgccagggacctccgggcgtggacctgtaccgcctggagaagctgagttccagcaggtaccaggatcaggcagtcctcttcatcccggccatgaagagaagtctggctggacgctaccgctgctcctaccagaacggaagcctctggtccctgcccagcgaccagctggagctcgttgccacgggagtttttgccaaaccctcgctctcagcccagcccggcccggcggtgtcgtcaggaggggacgtaaccctacagtgtcagactcggtatggctttgaccaatttgctctgtacaaggaaggggaccctgcgccctacaagaatcccgagagatggtacagggctagttttcccatcatcacggtgaccgccgcccacagcggaacctaccgatgctacagcttctccagcagggacccatacctgtggtcagcccccagcgaccccctggagcttgtggtcacagaattctcagaagccaccgctgaactgaccgtctcattcacaaacgaagtcttcacaactgagacttctaggagtatcaccgccagtccaaaggagtcagactctccagctggtcctgcccgccagtactacaccaagggcaacctggtccggatatgcctcggggctgtgatcctaataatcctggcggggtttctggcagaggactggcacagccggaggaagcgcctgcggcacaggggcagggctgtgcagaggccgcttccgcccctcccgcccctcccgctgacccggaaatcaaacgggggtcaggatggaggccgacaggatgttcacagccgcgggttatgttcatgaccgctgaaccccaggcacggtcgtatccaagggagggatcatggcatgggaggcgactcaaagactggcgtgtgtggagcgtggaagcaggagggcagaggctacagctgtggaaacgaggccatgctgcctcctcctggtgttccatcagggagccgttcggccagtgtctgtctgtctgtctgcctctctgtctgagggcaccctccatttgggatggaaggaatctgtggagaccccatcctcctccctgcacactgtggatgacatggtaccctggctggaccacatactggcctctttcttcaacctctctaatatgggctccagacggatctctaaggttcccagctctcagggttgactctgttccatcctctgtgcaaaatcctcccgtgcttccctttggccctctgtgctcttgtctggttttccccagaaactctcaccctcactccatctcccactgcggtctaacaaatctcctttcgtctctcagaacgggtcttgcaggcagtttgggtatgtcattcattttccttagtgtaaaactagcacgttgcccgcttcccttcacattagaaaacaagatcagcctgtgcaacatggtgaaacctcatctctaccaacaaaacaaaaaaacacaaaaattagccaggtgtggtggtgcatccctatactcccagcaactcagggggctgaggtgggagaatggcttgagcctgggaggcagaggttgcagtgagctgagatcacaccactgcactctagctcgggtgacgaagcctgactttgtctcaaaaaatacagggatgaatatgtcaattaccctgatttgatcatagcacgttgtatacatgtactgcaatattgctgtccaccccataaatatgtacaattctgtatacatttttaaaatcataaaaataagataatgcaccgtctccacccctctcatatttactttctgaaggaaatgttaggtcttctcaaggtaaagttctatatttattatagcgtttaggcatttcttgaccatctaatgagtgtaaaactgtaccactgggccaagtgcagtggatcatgtctgtaatcctagcactgtgggaggccaaggcaggaggatcgcttgagcccaggagttcaagaccagcctgggcaacatagtgagaccccatctctacttaaaataaagaagataaaaattgttttaaaa

SEQ ID NO: 138146 - DNA, 2264 bp, Homo sapiens
  Payload ID: 7062
  Gene Symbol: GP6
  Gene Name: glycoprotein VI (platelet)
  Uniprot ID: Q9HCN6
  ENST ID: ENST00000417454
  CDS Start-End: 29-1048
acagagctcaggacagggctgaggaaccatgtctccatccccgaccgccctcttctgtcttgggctgtgtctggggcgtgtgccagcgcagagtggaccgctccccaagccctccctccaggctctgcccagctccctggtgcccctggagaagccagtgaccctccggtgccagggacctccgggcgtggacctgtaccgcctggagaagctgagttccagcaggtaccaggatcaggcagtcctcttcatcccggccatgaagagaagtctggctggacgctaccgctgctcctaccagaacggaagcctctggtccctgcccagcgaccagctggagctcgttgccacgggagtttttgccaaaccctcgctctcagcccagcccggcccggcggtgtcgtcaggaggggacgtaaccctacagtgtcagactcggtatggctttgaccaatttgctctgtacaaggaaggggaccctgcgccctacaagaatcccgagagatggtacagggctagttttcccatcatcacggtgaccgccgcccacagcggaacctaccgatgctacagcttctccagcagggacccatacctgtggtcagcccccagcgaccccctggagcttgtggtcacaggaacctctgtgacccccagccggttaccaacagaaccaccttccccggtagcagaattctcagaagccaccgctgaactgaccgtctcattcacaaacgaagtcttcacaactgagacttctaggagtatcaccgccagtccaaaggagtcagactctccagctggtcctgcccgccagtactacaccaagggcaacctggtccggatatgcctcggggctgtgatcctaataatcctggcggggtttctggcagaggactggcacagccggaggaagcgcctgcggcacaggggcagggctgtgcagaggccgcttccgcccctcccgcccctcccgctgacccggaaatcaaacgggggtcaggatggaggccgacaggatgttcacagccgcgggttatgttcatgaccgctgaaccccaggcacggtcgtatccaagggagggatcatggcatgggaggcgactcaaagactggcgtgtgtggagcgtggaagcaggagggcagaggctacagctgtggaaacgaggccatgctgcctcctcctggtgttccatcagggagccgttcggccagtgtctgtctgtctgtctgcctctctgtctgagggcaccctccatttgggatggaaggaatctgtggagaccccatcctcctccctgcacactgtggatgacatggtaccctggctggaccacatactggcctctttcttcaacctctctaatatgggctccagacggatctctaaggttcccagctctcagggttgactctgttccatcctctgtgcaaaatcctcccgtgcttccctttggccctctgtgctcttgtctggttttccccagaaactctcaccctcactccatctcccactgcggtctaacaaatctcctttcgtctctcagaacgggtcttgcaggcagtttgggtatgtcattcattttccttagtgtaaaactagcacgttgcccgcttcccttcacattagaaaacaagatcagcctgtgcaacatggtgaaacctcatctctaccaacaaaacaaaaaaacacaaaaattagccaggtgtggtggtgcatccctatactcccagcaactcagggggctgaggtgggagaatggcttgagcctgggaggcagaggttgcagtgagctgagatcacaccactgcactctagctcgggtgacgaagcctgactttgtctcaaaaaatacagggatgaatatgtcaattaccctgatttgatcatagcacgttgtatacatgtactgcaatattgctgtccaccccataaatatgtacaattctgtatacatttttaaaatcataaaaataagataatgcaccgtctccacccctctcatatttactttctgaaggaaatgttaggtcttctcaaggtaaagttctatatttattatagcgtttaggcatttcttgaccatctaatgagtgtaaaactgtaccactgggccaagtgcagtggatcatgtctgtaatcctagcactgtgggaggccaaggcaggaggatcgcttgagcccaggagttcaagaccagcctgggcaacatagtgagaccccatctctacttaaaataaagaagataaaaattgttttaaaa

SEQ ID NO: 138147 - DNA, 876 bp, Homo sapiens
  Payload ID: 7062
  Gene Symbol: GP6
  Gene Name: glycoprotein VI (platelet)
  ENST ID: ENST00000468239
  CDS Start-End: 525-876
caccgtgtctaacacgaacaagtccacagagagcagtacgccaccatgccttgccctcctctcccaccacccccagccatggatctgctttcttctccatctcctatagatttacctattctggatatttcatgtaaatgacctcataaactatgtggctttttctgaccggtttctctcacttaaattacattcctgtgtgtcttttgaagaaattattaggacagagtaaagcatatgcatgcaaatgtcttatcaccgcgcccagcaggcaggaatgtccataaaagcgagtcctggcatctggtccctttcttctttcctcagggctgtgtctggggcgtgtgccagcgcagagtggaccgctccccaagccctccctccaggctctgcccagctccctggtgcccctggagaagccagtgaccctccggtgccagggacctccgggcgtggacctgtaccgcctggagaagctgagttccagcaggtaccaggatcaggcagtcctcttcatcccggccatgaagagaagtctggctggacgctaccgctgctcctaccagaacggaagcctctggtccctgcccagcgaccagctggagctcgttgccacgggagtttttgccaaaccctcgctctcagcccagcccggcccggcggtgtcgtcaggaggggacgtaaccctacagtgtcagactcggtatggctttgaccaatttgctctgtacaaggaaggggaccctgcgccctacaagaatcccgagagatggtacagggctagttttcccatcatcacggtgaccgccgcccacagcggaacctaccgatgctacagcttctccagcagggacccatacctgtggtcagccccca

SEQ ID NO: 138148 - DNA, 2268 bp, Homo sapiens; identical to SEQ ID NO: 138144
  Payload ID: 7062
  Gene Symbol: GP6
  Gene Name: glycoprotein VI (platelet)
  ENST ID: ENST00000614662
  CDS Start-End: 29-1891

SEQ ID NO: 138149 - DNA, 2210 bp, Homo sapiens; identical to SEQ ID NO: 138145
  Payload ID: 7062
  Gene Symbol: GP6
  Gene Name: glycoprotein VI (platelet)
  Uniprot ID: Q9HCN6
  ENST ID: ENST00000614889
  CDS Start-End: 29-994

SEQ ID NO: 138150 - DNA, 2210 bp, Homo sapiens; identical to SEQ ID NO: 138145
  Payload ID: 7062
  Gene Symbol: GP6
  Gene Name: glycoprotein VI (platelet)
  Uniprot ID: Q9HCN6
  ENST ID: ENST00000622653
  CDS Start-End: 29-994

SEQ ID NO: 138151 - DNA, 2210 bp, Homo sapiens; identical to SEQ ID NO: 138145
  Payload ID: 7062
  Gene Symbol: GP6
  Gene Name: glycoprotein VI (platelet)
  Uniprot ID: Q9HCN6
  ENST ID: ENST00000613801
  CDS Start-End: 29-994

SEQ ID NO: 138152 - DNA, 2268 bp, Homo sapiens; identical to SEQ ID NO: 138144
  Payload ID: 7062
  Gene Symbol: GP6
  Gene Name: glycoprotein VI (platelet)
  ENST ID: ENST00000619136
  CDS Start-End: 29-1891

SEQ ID NO: 138153 - DNA, 2210 bp, Homo sapiens; identical to SEQ ID NO: 138145
  Payload ID: 7062
  Gene Symbol: GP6
  Gene Name: glycoprotein VI (platelet)
  ENST ID: ENST00000621278
  CDS Start-End: 29-994

SEQ ID NO: 138154 - DNA, 2268 bp, Homo sapiens; identical to SEQ ID NO: 138144
  Payload ID: 7062
  Gene Symbol: GP6
  Gene Name: glycoprotein VI (platelet)
  Uniprot ID: Q9HCN6
  ENST ID: ENST00000613649
  CDS Start-End: 29-1891

SEQ ID NO: 138155 - DNA, 2210 bp, Homo sapiens; identical to SEQ ID NO: 138145
  Payload ID: 7062
  Gene Symbol: GP6
  Gene Name: glycoprotein VI (platelet)
  Uniprot ID: Q9HCN6
  ENST ID: ENST00000612184
  CDS Start-End: 29-994

SEQ ID NO: 138156 - DNA, 2268 bp, Homo sapiens; identical to SEQ ID NO: 138144
  Payload ID: 7062
  Gene Symbol: GP6
  Gene Name: glycoprotein VI (platelet)
  ENST ID: ENST00000610746
  CDS Start-End: 29-1891

SEQ ID NO: 138157 - DNA, 2210 bp, Homo sapiens; identical to SEQ ID NO: 138145
  Payload ID: 7062
  Gene Symbol: GP6
  Gene Name: glycoprotein VI (platelet)
  ENST ID: ENST00000610596
  CDS Start-End: 29-994

SEQ ID NO: 138158 - DNA, 2268 bp, Homo sapiens; identical to SEQ ID NO: 138144
  Payload ID: 7062
  Gene Symbol: GP6
  Gene Name: glycoprotein VI (platelet)
  ENST ID: ENST00000617954
  CDS Start-End: 29-1891

SEQ ID NO: 138159 - DNA, 2268 bp, Homo sapiens; identical to SEQ ID NO: 138144
  Payload ID: 7062
  Gene Symbol: GP6
  Gene Name: glycoprotein VI (platelet)
  ENST ID: ENST00000622589
  CDS Start-End: 29-1891

SEQ ID NO: 138160 - DNA, 2210 bp, Homo sapiens; identical to SEQ ID NO: 138145
  Payload ID: 7062
  Gene Symbol: GP6
  Gene Name: glycoprotein VI (platelet)
  ENST ID: ENST00000616319
  CDS Start-End: 29-994

SEQ ID NO: 138161 - DNA, 2268 bp, Homo sapiens; identical to SEQ ID NO: 138144
  Payload ID: 7062
  Gene Symbol: GP6
  Gene Name: glycoprotein VI (platelet)
  Uniprot ID: Q9HCN6
  ENST ID: ENST00000615407
  CDS Start-End: 29-1891

SEQ ID NO: 138162 - DNA, 2210 bp, Homo sapiens; identical to SEQ ID NO: 138145
  Payload ID: 7062
  Gene Symbol: GP6
  Gene Name: glycoprotein VI (platelet)
  ENST ID: ENST00000612096
  CDS Start-End: 29-994

SEQ ID NO: 138163 - DNA, 2268 bp, Homo sapiens; identical to SEQ ID NO: 138144
  Payload ID: 7062
  Gene Symbol: GP6
  Gene Name: glycoprotein VI (platelet)
  Uniprot ID: Q9HCN6
  ENST ID: ENST00000611436
  CDS Start-End: 29-1891

SEQ ID NO: 138164 - DNA, 2264 bp, Homo sapiens; identical to SEQ ID NO: 138146
  Payload ID: 7062
  Gene Symbol: GP6
  Gene Name: glycoprotein VI (platelet)
  Uniprot ID: Q9HCN6
  ENST ID: ENST00000616456
  CDS Start-End: 29-1048

SEQ ID NO: 138165 - DNA, 2210 bp, Homo sapiens; identical to SEQ ID NO: 138145
  Payload ID: 7062
  Gene Symbol: GP6
  Gene Name: glycoprotein VI (platelet)
  ENST ID: ENST00000612862
  CDS Start-End: 29-994

SEQ ID NO: 138166 - DNA, 876 bp, Homo sapiens; identical to SEQ ID NO: 138147
  Payload ID: 7062
  Gene Symbol: GP6
  Gene Name: glycoprotein VI (platelet)
  ENST ID: ENST00000617356
  CDS Start-End: 525-876

SEQ ID NO: 138167 - DNA, 2268 bp, Homo sapiens; identical to SEQ ID NO: 138144
  Payload ID: 7062
  Gene Symbol: GP6
  Gene Name: glycoprotein VI (platelet)
  Uniprot ID: Q9HCN6
  ENST ID: ENST00000622279
  CDS Start-End: 29-1891

SEQ ID NO: 138168 - DNA, 1604 bp, Homo sapiens
  Payload ID: 7063
  Gene Symbol: GLMP
  Gene Name: glycosylated lysosomal membrane protein
  Uniprot ID: Q8WWB7
  ENST ID: ENST00000362007
  CDS Start-End: 28-1248
ctcttccgtcggctgaattgcggccgtatgcgcggctctgtggagtgcacctggggttgggggcactgtgcccccagccccctgctcctttggactctacttctgtttgcagccccatttggcctgctgggggagaagacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttcacaggg

SEQ ID NO: 138169 - DNA, 837 bp, Homo sapiens
  Payload ID: 7063
  Gene Symbol: GLMP
  Gene Name: glycosylated lysosomal membrane protein
  ENST ID: ENST00000368264
  CDS Start-End: 10-561
tgcggccgtatgcgcggctctgtggagtgcacctggggttgggggcactgtgcccccagccccctgctcctttggactctacttctgtttgcagccccatttggcctgctgggggagaagacccgccagctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagaggagggattgaggccctgcctaggactcaggactcctgctgctagtcacagaataaggctgggagtggcaaggaaaagagggtcgggcacaggttggtcctctttaccctcccttgtttgcctttcttcccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcaccca

SEQ ID NO: 138170 - DNA, 658 bp, Homo sapiens
  Payload ID: 7063
  Gene Symbol: GLMP
  Gene Name: glycosylated lysosomal membrane protein
  ENST ID: ENST00000461597
  CDS Start-End: 1-228
ttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccagaccagtgtgcttttcttggagaaagaagaaaagaagaaagaaggaagaagaagaagaaagaaaggaggaagaaggaagaagaagagccagtgtgataatacattgagtgattttttaaaaagtgcatatatgagcaaaaagttatttttcccttttctgaagtatggcagcatactatatagactgtctctgcatgtttatttttcccccatttaatatatcctggagatcattttatatcaatataaaaatggttttctcattcttttata

SEQ ID NO: 138171 - DNA, 1188 bp, Homo sapiens
  Payload ID: 7063
  Gene Symbol: GLMP
  Gene Name: glycosylated lysosomal membrane protein
  ENST ID: ENST00000472870
  CDS Start-End: 10-402
tgcggccgtatgcgcggctctgtggagtgcacctggggttgggggcactgtgcccccagccccctgctcctttggactctacttctgtttgcagccccatttggcctgctgggggagaagacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccagagacatggtcttgctatgttgccagtctgggctcaaacttctggccttgagtgattctctcacctcagactcctgagtagctgggattacagatgcgggccaccacacctggctgtacaaactttaaaatgtttgagcaaattcaatgagtatagtaaaatatcttcctccctttaccgattcccaccctattctcccccacccccaccccaggcatcaatattatggtttcttgtgcactgagtgattttttaaattattattatttttttatttttgagacagagtctctctctgtcacccaggctggagtgcagtggtgcgatctcagctcactgcaacctccgcctcccgggttcaagcaattctcctgcctcagcctcctgagtagctgagactacgggcgcccgccaccatgcctggctatttttttgtatttttagtagagatggggtttcacccgagatggtctcaatctcctgacctgatgatccgcctgccttggcctcccaaagtgctgggattacaggcgtgagccaccgcgcctggcctattttttttttttt

SEQ ID NO: 138172 - DNA, 684 bp, Homo sapiens
  Payload ID: 7063
  Gene Symbol: GLMP
  Gene Name: glycosylated lysosomal membrane protein
  ENST ID: ENST00000481050
  CDS Start-End: 1-335
gcccctcaatgcaggagcagcactccatcgacgatgaatatgcaccggccgtcttccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttatttttttt

SEQ ID NO: 138173 - DNA, 795 bp, Homo sapiens
  Payload ID: 7063
  Gene Symbol: GLMP
  Gene Name: glycosylated lysosomal membrane protein
  ENST ID: ENST00000476177
  CDS Start-End: 9-278
gcggccgtatgcgcggctctgtggagtgcacctggggttgggggcactgtgcccccagccccctgctcctttggactctacttctgtttgcagccccatttggcctgctgggggagaagacccgccaggtgaggaggttgggagagaaccaaggagaagagtgcagaggagagagttcatcccaattagagggtggaactaaagactggggcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctg

SEQ ID NO: 138174 - DNA, 1364 bp, Homo sapiens
  Payload ID: 7063
  Gene Symbol: GLMP
  Gene Name: glycosylated lysosomal membrane protein
  ENST ID: ENST00000622703
  CDS Start-End: 45-1007
atgtgaccctctggcacctcttccgtcggctgaattgcggccgtatgcgcggctctgtggagtgcacctggggttgggggcactgtgcccccagccccctgctcctttggactctacttctgtttgcagccccatttggcctgctgggggagaagacccgccagctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttcacagggc

SEQ ID NO: 138175 - DNA, 1851 bp, Homo sapiens
  Payload ID: 7063
  Gene Symbol: GLMP
  Gene Name: glycosylated lysosomal membrane protein
  Uniprot ID: Q8WWB7
  ENST ID: ENST00000614643
  CDS Start-End: 517-1494
atgtgaccctctggcacctcttccgtcggctgaattgcggccgtatgcgcggctctgtggagtgcacctggggttgggggcactgtgcccccagccccctgctcctttggactctacttctgtttgcagccccatttggcctgctgggggagaagacccgccaggtgagggccctggggctacagcgatagaagtttcaggaaacgctacccttgcagggtggctggaaccgggcatccaggggctaggggtggagggtggctgccaagaggagggttcttcaacctggagggtgtgggagatggtcatgggtcatgggacgggattgtggagtagggcaaatgtgagggtgatgtctggaccccgactcagccctgggtgacccaggtccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttcacagggc

SEQ ID NO: 138176 - DNA, 1365 bp, Homo sapiens
  Payload ID: 7063
  Gene Symbol: GLMP
  Gene Name: glycosylated lysosomal membrane protein
  ENST ID: ENST00000612353
  CDS Start-End: 45-1040
atgtgaccctctggcacctcttccgtcggctgaattgcggccgtatgcgcggctctgtggagtgcacctggggttgggggcactgtgcccccagccccctgctcctttggactctacttctgtttgcagccccatttggcctgctgggggagaagacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccaggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttcacagggc

SEQ ID NO: 138177 - DNA, 2078 bp, Homo sapiens
  Payload ID: 7064
  Gene Symbol: GPAA1
  Gene Name: glycosylphosphatidylinositol anchor attachment 1
  Uniprot ID: O43292
  ENST ID: ENST00000355091
  CDS Start-End: 122-1987
gtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagcta

SEQ ID NO: 138178 - DNA, 1840 bp, Homo sapiens
  Payload ID: 7064
  Gene Symbol: GPAA1
  Gene Name: glycosylphosphatidylinositol anchor attachment 1
  Uniprot ID: O43292
  ENST ID: ENST00000361036
  CDS Start-End: 64-1749
gtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagcta

SEQ ID NO: 138179 - DNA, 835 bp, Homo sapiens
  Payload ID: 7064
  Gene Symbol: GPAA1
  Gene Name: glycosylphosphatidylinositol anchor attachment 1
  ENST ID: ENST00000530633
  CDS Start-End: 106-402
gtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgggctctgccagtggcctggcttgaacggacgatgcgatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaa

SEQ ID NO: 138180 - DNA, 937 bp, Homo sapiens
  Payload ID: 7064
  Gene Symbol: GPAA1
  Gene Name: glycosylphosphatidylinositol anchor attachment 1
  ENST ID: ENST00000525087
  CDS Start-End: 118-937
ctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagc

SEQ ID NO: 138181 - DNA, 825 bp, Homo sapiens
  Payload ID: 7064
  Gene Symbol: GPAA1
  Gene Name: glycosylphosphatidylinositol anchor attachment 1
  ENST ID: ENST00000524418
  CDS Start-End: 46-825
gttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaaggtggggctg

SEQ ID NO: 138182 - DNA, 878 bp, Homo sapiens
  Payload ID: 7064
  Gene Symbol: GPAA1
  Gene Name: glycosylphosphatidylinositol anchor attachment 1
  ENST ID: ENST00000529503
  CDS Start-End: 142-618
acatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcgatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaag

SEQ ID NO: 138183 - DNA, 986 bp, Homo sapiens
  Payload ID: 7064
  Gene Symbol: GPAA1
  Gene Name: glycosylphosphatidylinositol anchor attachment 1
  ENST ID: ENST00000528073
  CDS Start-End: 44-748
tggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactgcactcattcacttgctcctacaggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatgg

SEQ ID NO: 138184 - DNA, 535 bp, Homo sapiens
  Payload ID: 7064
  Gene Symbol: GPAA1
  Gene Name: glycosylphosphatidylinositol anchor attachment 1
  ENST ID: ENST00000530258
  CDS Start-End: 293-535
tcgcgcccctccggctgctcgcgcccttccgctcctgccctctggaagcactgagggtatcaggcccaggcttagggctcgggtccggcgtcccgatgcaggactccgggtttaggtctcccagacccgcgcgatcgaccccgggtgcggaggttgtggcctcgggtcggcgtctgaggacccgctgacgctccggtgcccctccgtcctctctcacagcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtac

SEQ ID NO: 138185 - DNA, 2282 bp, Homo sapiens
  Payload ID: 7065
  Gene Symbol: GPIHBP1
  Gene Name: glycosylphosphatidylinositol anchored high density lipoprotein binding protein 1
  Uniprot ID: Q8IV16
  ENST ID: ENST00000622500
  CDS Start-End: 76-630
ccttcatcccacttaccgcagctccagagccctgcgggaggactcagagtcagggacacagcagcgtccggcgagatgaaggcgctcggggctgtcctgcttgccctcttgctgttcgggcggccagggagagggcagacacagcaggaggaagaggaagaggacgaggaccacgggccagatgactacgacgaggaagatgaggatgaggtggaagaggaggagaccaacaggctccctggtggcaggagcagagtgctgctgcggtgctacacctgcaagtccctgcccagggacgagcgctgcaacctgacgcagaactgctcacatggccagacctgcacaaccctcattgcccacgggaacaccgagtcaggcctcctgaccacccactccacgtggtgcacagacagctgccagcccatcaccaagacggtggaggggacccaggtgaccatgacctgctgccagtccagcctgtgcaatgtcccaccctggcaaagctcccgagtccaggacccaacaggcaagggggcaggcggcccccggggcagctccgaaactgtgggcgcagccctcctgctcaacctccttgccggccttggagcaatgggggccaggagaccctgacccacggcccctccccacccccacccggctcacccccggccctgccagcactctgtctggtaccttcccctcctgcccctgcaccagctttggagaatggatttggagtgtcttgggcgatccagccagcgcaggccccccggcccggttgcttcctcagttcccggctgtgtccttggtgtcctttctccaccacctgtgagcagcaagactgccgcacgtgggcgctgggtccagacctcggctgccacgccccaggacctgcagccctcatgggggctggggatccccatcagcacagccaggcagagatgatacccaccacacacctgggggcccccacacccagtcctcacccttaacttctgccatgggaattcctccatctgcagcggtcacacgggcccaccctgcccttccccaggtcggcctctccgctgtctggagggaaggggatttggagggaggctgtcgtcgcccccaggaaagacgggcctgggggaggcgggacagtgggagaggcgcgctgaggatgagagggcacagggaggtgggttggggtgaggccacatgcggaggggcggggcgggggggggctggggggacaggcaccaagtatgaagaggatggggccagcggggcctgtctggctatggcgtgagcaccgctatgggagaccctggcttggaaagtgaacttgcagccttggatggggaagggccagatgctgggtgggtgcctgtcaccttgaggtgaccatctagggtcagtacctgctgggcttaggacagcgcctgaggctgggaatacctgtctctgctctagcagaggctaaagcaggctagagcagtggaggggtggagttgatgaaaggagaggagtagatgagatggaatttttccagcctcatcctggcctgccctctagactccagtccccaagccctcagcctagtgggtgtcatggatggatctgggggtgtcagacaggctaccctgtgccagggagggggcagaatgggcctgcagcttcctgcagaggaagcaggactgggtagcagagccgggaaggtgggtggcccattacaggggggtccccagggtgtcctctggcagggctgtgactgctgcaagctctgccttcaccagtagctggtgccaggacagagctctgggacagcaggcagaggccgagcctgggccacagctcagccactgacttgggtatcagtttccccttctgagaagtacagagtgagacttaaagaacccctagatccccaccagttcaacactccattaactgggaagcccagagtcctgtccggcctgccaagttcatcctggtggacagcgggaggcctccgctaactgttctcttcttttccttattaataaaacacacaatgcctagctggggggtcggaaggcaaatgccctagatggtggggtcacgtctttctccttctccttcctccttctgctggctgaagtgatgactggagctcagcaaccactttgcaccatgaggcagcactgagcacggtagggcagcctggtgagaggggcctagctcgctgccgacagaagtcactgcctacctcagggtccccttacctgggtgggaaataaatttctgctgtgttgaagcta

SEQ ID NO: 138186 - DNA, 723 bp, Homo sapiens
  Payload ID: 7066
  Gene Symbol: GML
  Gene Name: glycosylphosphatidylinositol anchored molecule like
  Uniprot ID: Q99445
  ENST ID: ENST00000220940
  CDS Start-End: 91-567
gtcggcgcgggaggctcagatggctggaggcggcgggcacgcacactgcggggctccgaggggcacaggtccaggctcctgcgtgaagtgatgctcctctttgccttactcctagccatggagctcccattggtggcagccagtgccaccatgcgcgctcagtggacttacagtttgagatgccatgactgtgcggtcataaatgacttcaactgtcccaacattagagtatgtccgtatcatattaggcgctgtatgacaatctccattcgcataaattctcgtgaactacttgtttataagaactgtacaaacaactgcacatttgtatatgcagctgaacagcctcctgaagccccaggaaaaatcttcaaaactaatagcttctactgggtttgttgttgtaatagcatggtttgcaatgcaggaggacctactaatcttgaaagggacatgttacccgatgaagtaactgaggaggagcttccagaaggaactgtgaggctgggggtatcaaaactgttgctgagttttgcctctatcatagtcagcaatatattgccatgaggaccccaccttggagggtctgaccatcttcacctgttccgcagagaaatgttgctctccattattcccttctaagccagagacccttatccactgctcctctaggtggcccatttatggtttgttgtaagagaaaaattaaaaaaatattgttta

SEQ ID NO: 138187 - DNA, 420 bp, Homo sapiens
  Payload ID: 7066
  Gene Symbol: GML
  Gene Name: glycosylphosphatidylinositol anchored molecule like
  ENST ID: ENST00000522728
  CDS Start-End: 66-420
caagcgaaagccaggcaggtctccccctgaaacctctgcacaggtccaggctcctgcgtgaagtgatgctcctctttgccttactcctagccatggagctcccattggtggcagccagtgccaccatgcgcgctcagtggacttacagtttgagatgccatgactgtgcggtcataaatgacttcaactgtcccaacattagagtatgtccgtatcatattaggcgctgtatgacaatctccattcagctttccagtggggacagagctgctgtgtgtccagggcctcatccaactttcttccagcctggagcatggatccccacacaggtgaccgactccaagcatcagcctctccctgcccacctgaccaggcgccaccctctccacgggccaggaaacatcctccccagtgccatca

SEQ ID NO: 138188 - DNA, 3489 bp, Homo sapiens
  Payload ID: 7067
  Gene Symbol: GPLD1
  Gene Name: glycosylphosphatidylinositol specific phospholipase D1
  Uniprot ID: P80108
  ENST ID: ENST00000230036
  CDS Start-End: 112-2634
gtgacctgcttagagagaagcggtgggtctgcacctggattttggagtcccagtgctgctgcagctctgagcattcccacgtcaccagagaagccggtgggcaatgagatcatgtctgctttcaggttgtggcctggcctgctgatcatgttgggttctctctgccatagaggttcaccgtgtggcctttcaacacacgtagaaataggacacagagctctggagtttcttcagcttcacaatgggcgtgttaactacagagagctgttactagaacaccaggatgcgtatcaggctggaatcgtgtttcctgattgtttttaccctagcatctgcaaaggaggaaaattccatgatgtgtctgagagcactcactggactccgtttcttaatgcaagcgttcattatatccgagagaactatccccttccctgggagaaggacacagagaaactggtagctttcttgtttggaattacttctcacatggcggcagatgtcagctggcatagtctgggccttgaacaaggattccttaggaccatgggagctattgattttcacggctcctattcagaggctcattcggctggtgattttggaggagatgtgttgagccagtttgaatttaattttaattaccttgcacgacgctggtatgtgccagtcaaagatctactgggaatttatgagaaactgtatggtcgaaaagtcatcaccgaaaatgtaatcgttgattgttcacatatccagttcttagaaatgtatggtgagatgctagctgtttccaagttatatcccacttactctacaaagtccccgtttttggtggaacaattccaagagtattttcttggaggactggatgatatggcattttggtccactaatatttaccatctaacaagcttcatgttggagaatgggaccagtgactgcaacctgcctgagaaccctctgttcattgcatgtggcggccagcaaaaccacacccagggctcaaaaatgcagaaaaatgattttcacagaaatttgactacatccctaactgaaagtgttgacaggaatataaactatactgaaagaggagtgttctttagtgtaaattcctggaccccggattccatgtcctttatctacaaggctttggaaaggaacataaggacaatgttcataggtggctctcagttgtcacaaaagcacgtctccagccccttagcatcttacttcttgtcatttccttatgcgaggcttggctgggcaatgacctcagctgacctcaaccaggatgggcacggtgacctcgtggtgggcgcaccaggctacagccgccccggccacatccacatcgggcgcgtgtacctcatctacggcaatgacctgggcctgccacctgttgacctggacctggacaaggaggcccacaggatccttgaaggcttccagccctcaggtcggtttggctcggccttggctgtgttggactttaacgtggacggcgtgcctgacctggccgtgggagctccctcggtgggctccgagcagctcacctacaaaggtgccgtgtatgtctactttggttccaaacaaggaggaatgtcttcttcccctaacatcaccatttcttgccaggacatctactgtaacttgggctggactctcttggctgcagatgtgaatggagacagtgaacccgatctggtcatcggctccccttttgcaccaggtggagggaagcagaagggaattgtggctgcgttttattctggccccagcctgagcgacaaagaaaaactgaacgtggaggcagccaactggacggtgagaggcgaggaagacttctcctggtttggatattcccttcacggtgtcactgtggacaacagaaccttgctgttggttgggagcccgacctggaagaatgccagcaggctgggccatttgttacacatccgagatgagaaaaagagccttgggagggtgtatggctacttcccaccaaacggccaaagctggtttaccatttctggagacaaggcaatggggaaactgggtacttccctttccagtggccacgtactgatgaatgggactctgaaacaagtgctgctggttggagcccctacgtacgatgacgtgtctaaggtggcattcctgaccgtgaccctacaccaaggcggagccactcgcatgtacgcactcacatctgacgcgcagcctctgctgctcagcaccttcagcggagaccgccgcttctcccgatttggtggcgttctgcacttgagtgacctggatgatgatggcttagatgaaatcatcatggcagcccccctgaggatagcagatgtaacctctggactgattgggggagaagacggccgagtatatgtatataatggcaaagagaccacccttggtgacatgactggcaaatgcaaatcatggataactccatgtccagaagaaaaggcccaatatgtattgatttctcctgaagccagctcaaggtttgggagctccctcatcaccgtgaggtccaaggcaaagaaccaagtcgtcattgctgctggaaggagttctttgggagcccgactctccggggcacttcacgtctatagccttggctcagattgaagatttcactgcatttccccactctgcccacctctctcatgctgaatcacatccatggtgagcattttgatggacaaagtggcacatccagtggagcggtggtagatcctgatagacatggggctcctgggagtagagagacacactaacagccacaccctctggaaatctgatacagtaaatatatgactgcaccagaaatatgtgaaatagcagacattctgcttactcatgtctccttccacagtttacttcctcgctccctttgcatctaaacctttcttctttcccaacttattgcctgtagtcagacctgctgtacaacctatttcctcttcctcttgaatgtctttccaatggctggaaaggtccctctgtggttatctgttagaacagtctctgtacacaattcctcctaaaaacatccttttttaaaaaaagaattgttcagccataaagaaagaacaagatcatgccctttgcagggacatggatggagctggaggccattatccttcataaactattgcaggaacagaaaaccaaacactccatattctcacttgtaagtgggagctaaatgagaacacgtggacacatagagggaaacaacacacactggggcctatgagagggcggaaggtgggaggagggagagatcaggaaaaataactaatggatacttagggtgatgaaataatctgtgtaacaaacccccatgacacacctttatgtatgtaacaaaccagcacttcctgcgcatgtacccctgaacttaaaagttaaaaaaaagttgaacttaaaaataacagattggcccatgccaatcaaagtataatagaaagcatagtatac

SEQ ID NO: 138189 - DNA, 2725 bp, Homo sapiens
  Payload ID: 7068
  Gene Symbol: GLT1D1
  Gene Name: glycosyltransferase 1 domain containing 1
  Uniprot ID: Q96MS3
  ENST ID: ENST00000281703
  CDS Start-End: 47-847
gtcggcggcggcggggccggtcgatggcccgggcggcggcggcggcatgcggctcctgttcctggcggtgctgcggccacacaccggcaacgcggtcacggcccagcgcgttcgggcccatctagaggctgcagggcacgtgtgcgttttgaaggatgcctttgactttgaaagccgatctgagattgcaaacctcatcttggctgagaactgcgaggctgccctggctcttcatctctataggggaggcaggcttttgcaaggccaccgaatcccttttggagtcatctttggtggaactgatgtaaatgaagatgccaaccaggcggaaaaaaacacagtcatgggcagagttcttgaggaagccagatttgctgtcgctttcacagagtcaatgaaggaaatggcacaagcgcagtgggtcgatccagtgtttacaagggaagtgaaagccaaagtgaaaagagccgctggggtacgattgattggagagatgcctcaagaagatctgcacgcggtggtgaagaattgcttcgcggtggtgaatagctctgtctctgaaggcatgtcagctgcaattttggaggcaatggatttagaagtaccggtattggccaggaacatccccgggaatgctgccgtggtgaagcatgaagtcacagggctactgttttccaatcctcaggagtttgttcatctggcaaagagactggttagtgatcctgcattagaaaaggaaatcgtagtgaacggaagggaatacgtgagaatgtatcattcatggcaggtggaaagagacacctaccaacagctcatcaggaagctggaaggaagcactgaagattgagggccccgcctcatcagacacctgctctctgacacacagctctgggtgcacactcagagacagagttctggatcacgtgggcccagtgcagttcaaataaaaccagcctcagcggaatcctagaaaatgttagtcgtgagtccccagagccactgcattcatcccatatccttctgtgcgttcagatgctgtcccaggcgtgttcaccagccagtcctgatggaggtgcatgagtgactgggttgactgggacagggaaaggggaactggttttcagggaatttgggagagaatttgattacctgccttagggctttggtgtggacaatagaggcttattttcaagcagtcatggttcagactcctcccgcctgccttctgaccaacctctccccatcgttgccagtttgaaaggcaaaagcaaaacagacgtgtcagctgagccgagtcctcgcaggatttttgttgtgatctcaggactctgacaggcacgtgggtgacccgaggcttctctgaacactagaaagcgctgtgagtgagctcacgcccggcacagctcacttttcaatggtggaattgaaagttgtgctttttagaaaagtggccaggctgcccgcaggccccgcccacctcttggctgaatttgagtggaaaaccaggaaggaacaagcgccacgtcacgcatagcctgcaaatcgcccgcgtgaccctgagatggaggcctgaggctttgggtccagggtgggctcttccccttcccacatcagggacccggggatggatgtcggaagggtcaccagcctccagcctttggcaggatggagcttgggtctgcagggctttgcagccacacagcgaggtcagtccggggccagccgcgccatcatggtaatggtggcctcgccccatccatgtcatccatgtcacatgaggacgtgcagtcttccttgtcctctcctagtggaatttgcctgggagaacctccactgaatactgaaattgttgcatgcctgtggattccttacgacaatggggaacgcggtgtttcccacctcttgtgggtagaaagcagtctgctttgaggaggcgagaaggcaaagccagggcagggcgttgctgtgggaagcgttcggtgaaagcgggtttcgacgcttaggagggccgagggagaagattccaccagcattgtccttgcttcaagttttaggatgtctgaactttcagctttcatgttttcaaccatcatttttttaatggcacaacctacatcttgtttttaaaagaagtagcctcaaattaaactccttaaactctgatgccctggggatgagaacaactagcttggatctcgtgccgtgtaattcaatgtttcattccgctgcctccatcatgtaatagaatcgctttccagaaaggcagttaactggaagcagcagaggctcccagccgtgagaggactgctcaacaatgccccccatcgccgcccccccacccctcgcaccccttgtgttttccctctgaggggcccaagggttatggctttcatgtctaggtgtggggacagaggagggagaggcagatcctgggccgggagaggatggcctggtctgaatctggagtaattaatgccacccaaagaaaaggccctgccaggtccaatgttgtcttagatctgatgatgctgctatttacaaaacactgatcgtccgaaagcttgaatctgttcctcctcgaatgaccctgtagatgcctgacctccaccgtacctccacatcactattcatgtccttctaggaaaatgtgcacatgcctcacgcactatgtgggaagggcgtgtttttaaattaataaagtgtgtcaccattagccatacgaaaa

SEQ ID NO: 138190 - DNA, 2995 bp, Homo sapiens
  Payload ID: 7068
  Gene Symbol: GLT1D1
  Gene Name: glycosyltransferase 1 domain containing 1
  Uniprot ID: Q96MS3
  ENST ID: ENST00000442111
  CDS Start-End: 89-1129
cggctcccccgccgtccgcgtctgcgccggccccggggcctggtcggcggcggcggggccggtcgatggcccgggcggcggcggcggcatgcggctcctgttcctggcggtgctgcggccacacaccggcaacgcggtcacggcccagcgcgttcgggcccatctagaggctgcagggcacgtgtgcgttttgaaggatgcctttgactttgaaagccgatctgagattgcaaacctcatcttggctgagaactgcgaggctgccctggctcttcatctctataggggaggcaggcttttgcaaggccaccgaatcccttttggagtcatctttggtggaactgatgtaaatgaagatgccaaccaggcggaaaaaaacacagtcatgggcagagttcttgaggaagccagatttgctgtcgctttcacagagtcaatgaaggaaatggcacaagcgcagtggccgcatgctaagggtaaggtctatgtccagagtcaaggaattgcaacaacaccaaacgccgcttttaactggaatacctttcttcaacgctctgagattaaccaaagtgctgataatttgcacatatttcttctgatatgtggacttcgacaagttaaggatcctctctatctggtggacgcattttcagcctggcatcaggaggagcccaatgtgcacctggtgattgtgggtcctgaagtcgatccagtgtttacaagggaagtgaaagccaaagtgaaaagagccgctggggtacgattgattggagagatgcctcaagaagatctgcacgcggtggtgaagaattgcttcgcggtggtgaatagctctgtctctgaaggcatgtcagctgcaattttggaggcaatggatttagaagtaccggtattggccaggaacatccccgggaatgctgccgtggtgaagcatgaagtcacagggctactgttttccaatcctcaggagtttgttcatctggcaaagagactggttagtgatcctgcattagaaaaggaaatcgtagtgaacggaagggaatacgtgagaatgtatcattcatggcaggtggaaagagacacctaccaacagctcatcaggaagctggaaggaagcactgaagattgagggccccgcctcatcagacacctgctctctgacacacagctctgggtgcacactcagagacagagttctggatcacgtgggcccagtgcagttcaaataaaaccagcctcagcggaatcctagaaaatgttagtcgtgagtccccagagccactgcattcatcccatatccttctgtgcgttcagatgctgtcccaggcgtgttcaccagccagtcctgatggaggtgcatgagtgactgggttgactgggacagggaaaggggaactggttttcagggaatttgggagagaatttgattacctgccttagggctttggtgtggacaatagaggcttattttcaagcagtcatggttcagactcctcccgcctgccttctgaccaacctctccccatcgttgccagtttgaaaggcaaaagcaaaacagacgtgtcagctgagccgagtcctcgcaggatttttgttgtgatctcaggactctgacaggcacgtgggtgacccgaggcttctctgaacactagaaagcgctgtgagtgagctcacgcccggcacagctcacttttcaatggtggaattgaaagttgtgctttttagaaaagtggccaggctgcccgcaggccccgcccacctcttggctgaatttgagtggaaaaccaggaaggaacaagcgccacgtcacgcatagcctgcaaatcgcccgcgtgaccctgagatggaggcctgaggctttgggtccagggtgggctcttccccttcccacatcagggacccggggatggatgtcggaagggtcaccagcctccagcctttggcaggatggagcttgggtctgcagggctttgcagccacacagcgaggtcagtccggggccagccgcgccatcatggtaatggtggcctcgccccatccatgtcatccatgtcacatgaggacgtgcagtcttccttgtcctctcctagtggaatttgcctgggagaacctccactgaatactgaaattgttgcatgcctgtggattccttacgacaatggggaacgcggtgtttcccacctcttgtgggtagaaagcagtctgctttgaggaggcgagaaggcaaagccagggcagggcgttgctgtgggaagcgttcggtgaaagcgggtttcgacgcttaggagggccgagggagaagattccaccagcattgtccttgcttcaagttttaggatgtctgaactttcagctttcatgttttcaaccatcatttttttaatggcacaacctacatcttgtttttaaaagaagtagcctcaaattaaactccttaaactctgatgccctggggatgagaacaactagcttggatctcgtgccgtgtaattcaatgtttcattccgctgcctccatcatgtaatagaatcgctttccagaaaggcagttaactggaagcagcagaggctcccagccgtgagaggactgctcaacaatgccccccatcgccgcccccccacccctcgcaccccttgtgttttccctctgaggggcccaagggttatggctttcatgtctaggtgtggggacagaggagggagaggcagatcctgggccgggagaggatggcctggtctgaatctggagtaattaatgccacccaaagaaaaggccctgccaggtccaatgttgtcttagatctgatgatgctgctatttacaaaacactgatcgtccgaaagcttgaatctgttcctcctcgaatgaccctgtagatgcctgacctccaccgtacctccacatcactattcatgtccttctaggaaaatgtgcacatgcctcacgcactatgtgggaagggcgtgtttttaaattaataaagtgtgtcaccatta

SEQ ID NO: 138191 - DNA, 2233 bp, Homo sapiens
  Payload ID: 7068
  Gene Symbol: GLT1D1
  Gene Name: glycosyltransferase 1 domain containing 1
  ENST ID: ENST00000413816
  CDS Start-End: 1-363
gtgctgcggccacacaccggcaacgcggtcacggcccagcgcgttcgggcccatctagaggctgcagggcacgtgtgcgttttgaaggatgcctttgactttgaaagccgatctgagattgcaaacctcatcttggctgagaactgcgaggctgccctggctcttcatctctataggggaggcaggcttttgcaaggccaccgaatcccttttggagtcatctttggtggaactgatgtaaatgaagatgccaaccaggcggaaaaaaacacagtcatgggcagagttcttgaggaagccagatttgctgtcgctttcacagagtcaatgaaggaaatggcacaagcgcagtgggtatgttgaacttgccctttttttgtttctttgacccaggaattgcaacaacaccaaacgccgcttttaactggaatacctttcttcaacgctctgagattaaccaaagtgctgataatttgcacatatttcttctgatatgtggacttcgacaagttaaggatcctctctatctggtggacgcattttcagcctggcatcaggaggagcccaatgtgcacctggtgattgtgggtcctgaagtaaattcttggaatcagagccactcttcctgctttgtgtttcagagccgctggggtacgattgattggagagatgcctcaagaagatctgcacgcggtggtgaagaattgcttcgcggtggtgaatagctctgtctctgaaggcatgtcagctgcaattttggaggcaatggatttagaagtaccggtattggccaggaacatccccgggaatgctgccgtggtgaagcatgaagtcacagggctactgttttccaatcctcaggagtttgttcatctggcaaagagactggttagtgatcctgcattagaaaaggaaatcgtagtgaacggaagggaatacgtgagaatgtatcattcatggcaggtggaaagagacacctaccaacagctcatcaggaagctggaaggaagcactgaagattgagggccccgcctcatcagacacctgctctctgacacacagctctgggtgcacactcagagacagagttctggatcacgtgggcccagtgcagttcaaataaaaccagcctcagcggaatcctagaaaatgttagtcgtgagtccccagagccactgcattcatcccatatccttctgtgcgttcagatgctgtcccaggcgtgttcaccagccagtcctgatggaggtgcatgagtgactgggttgactgggacagggaaaggggaactggttttcagggaatttgggagagaatttgattacctgccttagggctttggtgtggacaatagaggcttattttcaagcagtcatggttcagactcctcccgcctgccttctgaccaacctctccccatcgttgccagtttgaaaggcaaaagcaaaacagacgtgtcagctgagccgagtcctcgcaggatttttgttgtgatctcaggactctgacaggcacgtgggtgacccgaggcttctctgaacactagaaagcgctgtgagtgagctcacgcccggcacagctcacttttcaatggtggaattgaaagttgtgctttttagaaaagtggccaggctgcccgcaggccccgcccacctcttggctgaatttgagtggaaaaccaggaaggaacaagcgccacgtcacgcatagcctgcaaatcgcccgcgtgaccctgagatggaggcctgaggctttgggtccagggtgggctcttccccttcccacatcagggacccggggatggatgtcggaagggtcaccagcctccagcctttggcaggatggagcttgggtctgcagggctttgcagccacacagcgaggtcagtccggggccagccgcgccatcatggtaatggtggcctcgccccatccatgtcatccatgtcacatgaggacgtgcagtcttccttgtcctctcctagtggaatttgcctgggagaacctccactgaatactgaaattgttgcatgcctgtggattccttacgacaatggggaacgcggtgtttcccacctcttgtgggtagaaagcagtctgctttgaggaggcgagaaggcaaagccagggcagggcgttgctgtgggaagcgttcggtgaaagcgggtttcgacgcttaggagggccgagggagaagattccaccagcattgtccttgcttcaagttttaggat

SEQ ID NO: 138192 - DNA, 3010 bp, Homo sapiens
  Payload ID: 7068
  Gene Symbol: GLT1D1
  Gene Name: glycosyltransferase 1 domain containing 1
  Uniprot ID: Q96MS3
  ENST ID: ENST00000441390
  CDS Start-End: 156-614
tggcgccggaacctgcgagctggggcgcggcctcggggaggggcgggcgggacagacccagccgccccggctcccccgccgtccgcgtctgcgccggccccggggcctggtcggcggcggcggggccggtcgatggcccgggcggcggcggcggcatgcggctcctgttcctggcggtgctgcggccacacaccggcaacgcggtcacggcccagcgcgttcgggcccatctagaggctgcagggcacgtgtgcgttttgaaggatgcctttgactttgaaagccgatctgagattgcaaacctcatcttggctgagaactgcgaggctgccctggctcttcatctctataggggaggcaggcttttgcaaggccaccgaatcccttttggagtcatctttggtggaactgatgtaaatgaagatgccaaccaggcggaaaaaaacacagtcatgggcagagttcttgaggaagccagccgcatgctaagggtaaggtctatgtccagagtcaaggaattgcaacaacaccaaacgccgcttttaactggaatacctttcttcaacgctctgagattaaccaaagtgctgataatttgcacatatttcttctgatatgtggacttcgacaagttaaggatcctctctatctggtggacgcattttcagcctggcatcaggaggagcccaatgtgcacctggtgattgtgggtcctgaagtcgatccagtgtttacaagggaagtgaaagccaaagtgaaaagagccgctggggtacgattgattggagagatgcctcaagaagatctgcacgcggtggtgaagaattgcttcgcggtggtgaatagctctgtctctgaaggcatgtcagctgcaattttggaggcaatggatttagaagtaccggtattggccaggaacatccccgggaatgctgccgtggtgaagcatgaagtcacagggctactgttttccaatcctcaggagtttgttcatctggcaaagagactggttagtgatcctgcattagaaaaggaaatcgtagtgaacggaagggaatacgtgagaatgtatcattcatggcaggtggaaagagacacctaccaacagctcatcaggaagctggaaggaagcactgaagattgagggccccgcctcatcagacacctgctctctgacacacagctctgggtgcacactcagagacagagttctggatcacgtgggcccagtgcagttcaaataaaaccagcctcagcggaatcctagaaaatgttagtcgtgagtccccagagccactgcattcatcccatatccttctgtgcgttcagatgctgtcccaggcgtgttcaccagccagtcctgatggaggtgcatgagtgactgggttgactgggacagggaaaggggaactggttttcagggaatttgggagagaatttgattacctgccttagggctttggtgtggacaatagaggcttattttcaagcagtcatggttcagactcctcccgcctgccttctgaccaacctctccccatcgttgccagtttgaaaggcaaaagcaaaacagacgtgtcagctgagccgagtcctcgcaggatttttgttgtgatctcaggactctgacaggcacgtgggtgacccgaggcttctctgaacactagaaagcgctgtgagtgagctcacgcccggcacagctcacttttcaatggtggaattgaaagttgtgctttttagaaaagtggccaggctgcccgcaggccccgcccacctcttggctgaatttgagtggaaaaccaggaaggaacaagcgccacgtcacgcatagcctgcaaatcgcccgcgtgaccctgagatggaggcctgaggctttgggtccagggtgggctcttccccttcccacatcagggacccggggatggatgtcggaagggtcaccagcctccagcctttggcaggatggagcttgggtctgcagggctttgcagccacacagcgaggtcagtccggggccagccgcgccatcatggtaatggtggcctcgccccatccatgtcatccatgtcacatgaggacgtgcagtcttccttgtcctctcctagtggaatttgcctgggagaacctccactgaatactgaaattgttgcatgcctgtggattccttacgacaatggggaacgcggtgtttcccacctcttgtgggtagaaagcagtctgctttgaggaggcgagaaggcaaagccagggcagggcgttgctgtgggaagcgttcggtgaaagcgggtttcgacgcttaggagggccgagggagaagattccaccagcattgtccttgcttcaagttttaggatgtctgaactttcagctttcatgttttcaaccatcatttttttaatggcacaacctacatcttgtttttaaaagaagtagcctcaaattaaactccttaaactctgatgccctggggatgagaacaactagcttggatctcgtgccgtgtaattcaatgtttcattccgctgcctccatcatgtaatagaatcgctttccagaaaggcagttaactggaagcagcagaggctcccagccgtgagaggactgctcaacaatgccccccatcgccgcccccccacccctcgcaccccttgtgttttccctctgaggggcccaagggttatggctttcatgtctaggtgtggggacagaggagggagaggcagatcctgggccgggagaggatggcctggtctgaatctggagtaattaatgccacccaaagaaaaggccctgccaggtccaatgttgtcttagatctgatgatgctgctatttacaaaacactgatcgtccgaaagcttgaatctgttcctcctcgaatgaccctgtagatgcctgacctccaccgtacctccacatcactattcatgtccttctaggaaaatgtgcacatgcctcacgcactatgtgggaagggcgtgtttttaaattaataaagtgtgtcaccatta

SEQ ID NO: 138193 - DNA, 1714 bp, Homo sapiens
  Payload ID: 7068
  Gene Symbol: GLT1D1
  Gene Name: glycosyltransferase 1 domain containing 1
  ENST ID: ENST00000537468
  CDS Start-End: 10-1065
agtcttaacatgctgactgcgaggtgcctgtcagacgacacactggcccatctagaggctgcagggcacgtgtgcgttttgaaggatgcctttgactttgaaagccgatctgagattgcaaacctcatcttggctgagaactgcgaggctgccctggctcttcatctctataggggaggcaggcttttgcaaggccaccgaatcccttttggagtcatctttggtggaactgatgtaaatgaagatgccaaccaggcggaaaaaaacacagtcatgggcagagttcttgaggaagccagatttgctgtcgctttcacagagtcaatgaaggaaatggcacaagcgcagtggaaagcaagacagatctcattggctgtcacaagtgcagttcctgtacagccgcatgctaagggtaaggtctatgtccagagtcaaggaattgcaacaacaccaaacgccgcttttaactggaatacctttcttcaacgctctgagattaaccaaagtgctgataatttgcacatatttcttctgatatgtggacttcgacaagttaaggatcctctctatctggtggacgcattttcagcctggcatcaggaggagcccaatgtgcacctggtgattgtgggtcctgaagtcgatccagtgtttacaagggaagtgaaagccaaagtgaaaagagccgctggggtacgattgattggagagatgcctcaagaagatctgcacgcggtggtgaagaattgcttcgcggtggtgaatagctctgtctctgaaggcatgtcagctgcaattttggaggcaatggatttagaagtaccggtattggccaggaacatccccgggaatgctgccgtggtgaagcatgaagtcacagggctactgttttccaatcctcaggagtttgttcatctggcaaagagactggttagtgatcctgcattagaaaaggaaatcgtagtgaacggaagggaatacgtgagaatgtatcattcatggcaggtggaaagagacacctaccaacagctcatcaggaagctggaaggaagcactgaagattgagggccccgcctcatcagacacctgctctctgacacacagctctgggtgcacactcagagacagagttctggatcacgtgggcccagtgcagttcaaataaaaccagcctcagcggaatcctagaaaatgttagtcgtgagtccccagagccactgcattcatcccatatccttctgtgcgttcagatgctgtcccaggcgtgttcaccagccagtcctgatggaggtgcatgagtgactgggttgactgggacagggaaaggggaactggttttcagggaatttgggagagaatttgattacctgccttagggctttggtgtggacaatagaggcttattttcaagcagtcatggttcagactcctcccgcctgccttctgaccaacctctccccatcgttgccagtttgaaaggcaaaagcaaaacagacgtgtcagctgagccgagtcctcgcaggatttttgttgtgatctcaggactctgacaggcacgtgggtgacccgaggcttctctgaacactagaaagcgctgtgagtgagctcacgcccggcacagctcacttttcaatggtggaattgaaagttgtgctttttagaaaagtggccaggctgcccgcaggccccgcccacctcttggctgaatttgagt

SEQ ID NO: 138194 - DNA, 791 bp, Homo sapiens
  Payload ID: 7068
  Gene Symbol: GLT1D1
  Gene Name: glycosyltransferase 1 domain containing 1
  Uniprot ID: Q96MS3
  ENST ID: ENST00000539044
  CDS Start-End: 1-459
atgcggctcctgttcctggcggtgctgcggccacacaccggcaacgcggtcacggcccagcgcgttcgggcccatctagaggctgcagggcacgtgtgcgttttgaaggatgcctttgactttgaaagccgatctgagattgcaaacctcatcttggctgagaactgcgaggctgccctggctcttcatctctataggggaggcaggcttttgcaaggccaccgaatcccttttggagtcatctttggtggaactgatgtaaatgaagatgccaaccaggcggaaaaaaacacagtcatgggcagagttcttgaggaagccagccgcatgctaagggtaaggtctatgtccagagtcaaggaattgcaacaacaccaaacgccgcttttaactggaatacctttcttcaacgctctgagattaaccaaagtgctgataatttgcacatatttcttctgatatgtggacttcgacaagttaaggatcctctctatctggtggacgcattttcagcctggcatcaggaggagcccaatgtgcacctggtgattgtgggtcctgaaaacattgaaagaaaaacttctagtttgatgctaaaattctggctaatcaagagagaaggcctcagactgggagccatgagcaggcaacaacagtatctagaaggcatttaataatgtggttttctttttcattgttttcattctgatgatcacatctcaggtacagtgcttgataccagctttccaattatgaaaattgcctttcaaaataaattgacttcacaaaaa

SEQ ID NO: 138195 - DNA, 1526 bp, Homo sapiens
  Payload ID: 7069
  Gene Symbol: GLT6D1
  Gene Name: glycosyltransferase 6 domain containing 1
  Uniprot ID: Q7Z4J2
  ENST ID: ENST00000371763
  CDS Start-End: 255-1085
attctcctagatcaagaagacttcctcatcaagacctcattctatttgcacagccctgcagtggagagatttattgcgtttctttcatgcaatcaacgcagactttgatgtgaacacggggagagacagtgcacgtgcagctgacccacggggaacagtcagccccgggcacttgaaggagaacagaggcttccctaactcaagtcgctgtctcctgccagctgaacattctagaagcaacctctaaggagagaatgaattctaaaagaatgctgttattggttttatttgctttttcactgatgttggttgagcgttatttcaggaatcaccaagtagaagaacttcggctctcagactggtttcatcctagaaaacgccctgatgttataacgaaaacagactggctcgctcctgtcctatgggaagggactttcgacaggcgggtcctggaaaaacattacagaaggcggaatatcactgtgggcctggccgtctttgctactggcaggtttgcagaggagtacctgaggccgttcctacactccgcaaataagcacttcatgacaggctaccgagtgatcttctacatcatggtggacgccttcttcaagctgcctgacatagagcccagtcctcttcgaacgttcaaagcatttaaagtgggcaccgagaggtggtggctcgatggccccctggtgcatgtgaagagcctgggtgaacacatcgccagtcacatccaggacgaggtggacttcctcttcagcatggctgccaaccaggtcttccagaatgagttcggggtggagaccctgggcccgttggtggcccagctccacgcctggtggtatttcagaaacaccaagaacttcccttatgagaggaggccgacctcagcagcttgcatcccgtttggacagggagatttctattatggcaacttgatggttggtggcacaccccataatattttagacttcatcaaagaatatctgaacggagttattcatgacatcaaaaatggactcaatagcacttatgaaaagcaccttaacaaatatttttacctcaataaacccacctagctgttatcaccagcatacagctgggatcttgcattttctcctcctccacagatccaatacgtcaaggtcgcacatgattcccagaggaaattatgaattacgccatgaggtttatgacgaataaatgaatcacggcaatttcttataaatgagggaagtcttaagaccttccattttttagagacatacaaatttacatccttcccaaataaatgtttcttcttgccattttgagccatcttatttggctaatgtaggataaagaataaaaggataattacttaatgttaatacacagtaatgttattatctatgtattgtagacaatgtgaaaatacatttgacatagaatgaatatttttaatggagaaagactctagttgagaaaaaacattcataaaatggaaaagtagttcacgcaaaggaaaaaataaatgccag

SEQ ID NO: 138196 - DNA, 1523 bp, Homo sapiens
  Payload ID: 7069
  Gene Symbol: GLT6D1
  Gene Name: glycosyltransferase 6 domain containing 1
  ENST ID: ENST00000613244
  CDS Start-End: 255-1178
attctcctagatcaagaagacttcctcatcaagacctcattctatttgcacagccctgcagtggagagatttattgcgtttctttcatgcaatcaacgcagactttgatgtgaacacggggagagacagtgcacgtgcagctgacccacggggaacagtcagccccgggcacttgaaggagaacagaggcttccctaactcaagtcgctgtctcctgccagctgaacattctagaagcaacctctaaggagagaatgaattctaaaagaatgctgttattggttttatttgctttttcactgatgttggttgagcgttatttcaggaatcaccaagtagaagaacttcggctctcagactggtttcatcctagaaaacgccctgatgttataacgaaaacagactggctcgctcctgtcctatgggaagggactttcgacaggcgggtcctggaaaaacattacagaaggcggaatatcactgtgggcctggccgtctttgctactggcaggtttgcagaggagtacctgaggccgttcctacactccgcaaataagcacttcatgacaggctaccgagtgatcttctacatcatggtggacgccttcttcaagctgcctgacatagagcccagtcctcttcgaacgttcaaagcatttaaagtgggcaccgagaggtggtggctcgatggccccctggtgcatgtgaagagcctgggtgaacacatcgccagtcacatccaggacgaggtggacttcctcttcagcatggctgccaaccaggtcttccagaatgagttcggggtggagaccctgggcccgttggtggcccagctccacgcctggtggtatttcagaaacaccaagaacttcccttatgagaggaggccgacctcagcagcttgcatcccgtttggacagggagatttctattatggcaacttgatggttggtggcacaccccataatattttagacttcatcaaagaatatctgaacggagttattcatgacatcaaaaatggactcaatagcacttatgaaaagcaccttaacaaatatttttacctcaataaacccaccctgttatcaccagcatacagctgggatcttgcattttctcctcctccacagatccaatacgtcaaggtcgcacatgattcccagaggaaattatgaattacgccatgaggtttatgacgaataaatgaatcacggcaatttcttataaatgagggaagtcttaagaccttccattttttagagacatacaaatttacatccttcccaaataaatgtttcttcttgccattttgagccatcttatttggctaatgtaggataaagaataaaaggataattacttaatgttaatacacagtaatgttattatctatgtattgtagacaatgtgaaaatacatttgacatagaatgaatatttttaatggagaaagactctagttgagaaaaaacattcataaaatggaaaagtagttcacgcaaaggaaaaaataaatgccag

SEQ ID NO: 138197 - DNA, 2149 bp, Homo sapiens
  Payload ID: 7070
  Gene Symbol: GLT8D1
  Gene Name: glycosyltransferase 8 domain containing 1
  Uniprot ID: Q68CQ7
  ENST ID: ENST00000266014
  CDS Start-End: 674-1789
gacgggccggtacagcccgtgtccccgccccgcgccatcgctaggcgacgtgcgcttttgccgcgccgtgctgcccgcgagggcagctgaggtggtggtggcggccgccttgtcgaggcatcgcgcgcccgtgaagtgttcgccgtcagtgctgttgggtgcctggagccgcgtcccccgtcccgaaaactgtccttgacagtacttgcgcggcccaacggccgccggcgcccccgcgtctccatggcgacggcctttttccctgcgaggaccccggcggcagggctgccccgcggcgcctgcttggcgcgacgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttcaataggt

SEQ ID NO: 138198 - DNA, 1621 bp, Homo sapiens
  Payload ID: 7070
  Gene Symbol: GLT8D1
  Gene Name: glycosyltransferase 8 domain containing 1
  Uniprot ID: Q68CQ7
  ENST ID: ENST00000394783
  CDS Start-End: 153-1268
gtgggatttatttgagtgcaagatcgttttctcagtggtggtggaagttgcctcatcgcaggcagatgttggggctttgtccgaacagctcccctctgccagcttctgtagataagggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttc

SEQ ID NO: 138199 - DNA, 1419 bp, Homo sapiens
  Payload ID: 7070
  Gene Symbol: GLT8D1
  Gene Name: glycosyltransferase 8 domain containing 1
  ENST ID: ENST00000407584
  CDS Start-End: 739-1419
ccaagtgtgcctcttgatcccgtaactgctaactggaagtcaagaaactaaaaacattatctcttgtaccattaattaagtgggatttatttgagtgcaagatcgttttctcagtggtggtggaagttgcctcatcgcaggcagatgttggggctttgtccgaacagctcccctctgccagcttctgtagataagggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatccgccaccttggttccagtgctggaaaacgatattcacctcagtttgtaaaggctgccaagttactcattggaatggacatttgaagccatggggaaggactgcttcatatacttgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctag

SEQ ID NO: 138200 - DNA, 724 bp, Homo sapiens
  Payload ID: 7070
  Gene Symbol: GLT8D1
  Gene Name: glycosyltransferase 8 domain containing 1
  ENST ID: ENST00000489119
  CDS Start-End: 377-724
gcctgcttggcgcgacgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgat

SEQ ID NO: 138201 - DNA, 720 bp, Homo sapiens
  Payload ID: 7070
  Gene Symbol: GLT8D1
  Gene Name: glycosyltransferase 8 domain containing 1
  ENST ID: ENST00000479553
  CDS Start-End: 198-720
attgggttcttgggaactgtgaattcaaaatgagtttctggcggaatactgtatatgcctcttgtttcttcctgaattaaaaaaaaaaaaaaagtgttagggcattttgatgtcccttctcatgtgcttactgactttgggggcttgtttttgttttgtagggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaa

SEQ ID NO: 138202 - DNA, 622 bp, Homo sapiens
  Payload ID: 7070
  Gene Symbol: GLT8D1
  Gene Name: glycosyltransferase 8 domain containing 1
  ENST ID: ENST00000464705
  CDS Start-End: 531-622
cgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtagatggggtttcaccatcttggacaggctggtctcgaactcctgacctcttgatccacctgccttggcctcccaaagtgctgggattacagacgtgagccacggcgccctgatgtatatgagaagaagttcactgacacgttgtacttcatatatactgctttggaaagggttaaaaactaatatttatatgacagaagaaaaagatgtcattccgtaaagtaaacatcatcatcttggtcctggctgttgctctcttcttactggttttgcaccataacttcctcagcttgagcag

SEQ ID NO: 138203 - DNA, 796 bp, Homo sapiens
  Payload ID: 7070
  Gene Symbol: GLT8D1
  Gene Name: glycosyltransferase 8 domain containing 1
  ENST ID: ENST00000481643
  CDS Start-End: 1-72
gtaaaggaggatcctgaccagggggaatccatgaaacctgtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacaga

SEQ ID NO: 138204 - DNA, 1577 bp, Homo sapiens
  Payload ID: 7070
  Gene Symbol: GLT8D1
  Gene Name: glycosyltransferase 8 domain containing 1
  Uniprot ID: Q68CQ7
  ENST ID: ENST00000491606
  CDS Start-End: 120-1235
cttggcgcgacgctctagcggttaccgctgcgggctggctgggcgtagtggggctgcgcggctgccacggagctagagggcaaggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaac

SEQ ID NO: 138205 - DNA, 789 bp, Homo sapiens
  Payload ID: 7070
  Gene Symbol: GLT8D1
  Gene Name: glycosyltransferase 8 domain containing 1
  ENST ID: ENST00000497953
  CDS Start-End: 600-789
gggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtcagaccgaggacacggttgttaccaagaccaggctgttgccttggaagagcccagagcgtgtcaagggagacagccacatcacgccagaaatacatgacagctggattagccctgggagagggaggcccagatgtgggagctcaggggaggtgcagctcaacgtggagtttggaggaggctaccttgacctttgaatgccaagtgggagccagccagatgaaaggatccagcgtctgtgtgcaatttcgttttgagaattccttctaaccagatcaggaaagctctcttaccaggaatagccccaggaaagacaatatggattagacgtactccatgataactggcgttttgcatggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaag

SEQ ID NO: 138206 - DNA, 1826 bp, Homo sapiens
  Payload ID: 7070
  Gene Symbol: GLT8D1
  Gene Name: glycosyltransferase 8 domain containing 1
  Uniprot ID: Q68CQ7
  ENST ID: ENST00000478968
  CDS Start-End: 355-1470
gcggcgcctgcttggcgcgacgctctagcggttaccgctgcgggctggctgggcgtagtggggctgcgcggctgccacggagctagaggacagcagaccgaggacacggttgttaccaagaccaggctgttgccttggaagagcccagagcgtgtcaagggagacagccacatcacgccagaaatacatgacagctggattagccctgggagagggaggcccagatgtgggagctcaggggaggtgcagctcaacgtggagtttggaggaggctaccttgacctttgaatgccaagtgggagccagccagatgaaaggggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttcaat

SEQ ID NO: 138207 - DNA, 577 bp, Homo sapiens
  Payload ID: 7070
  Gene Symbol: GLT8D1
  Gene Name: glycosyltransferase 8 domain containing 1
  ENST ID: ENST00000497436
  CDS Start-End: 310-577
atggcgacggcctttttccctgcgaggaccccggcggcagggctgccccgcggcgcctgcttggcgcgacgctctagcggttaccgctgcgggctggctgggcgtagtggggctgcgcggctgccacggagctagaggttacaatggctagaaatgtactccacacttttgatatcgattggattttgtgaatttttgtagctttttctgtgctgtgggtttgtcaagtgaatttggataatattcttttctctgaggacactcatgttaaagggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcaca

SEQ ID NO: 138208 - DNA, 770 bp, Homo sapiens
  Payload ID: 7070
  Gene Symbol: GLT8D1
  Gene Name: glycosyltransferase 8 domain containing 1
  ENST ID: ENST00000487642
  CDS Start-End: 584-770
gcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtacagcagaccgaggacacggttgttaccaagaccaggctgttgccttggaagagcccagagcgtgtcaagggagacagccacatcacgccagaaatacatgacagctggattagccctgggagagggaggcccagatgtgggagctcaggggaggtgcagctcaacgtggagtttggaggaggctaccttgacctttgaatgccaagtgggagccagccagatgaaaggggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagac

SEQ ID NO: 138209 - DNA, 1880 bp, Homo sapiens
  Payload ID: 7071
  Gene Symbol: GLT8D2
  Gene Name: glycosyltransferase 8 domain containing 2
  Uniprot ID: Q9H1C3
  ENST ID: ENST00000360814
  CDS Start-End: 407-1456
aagaaacccgagacgttccgaagtcaacgcaagcaaaggggagtgcgggtcggggaggaatattcttttggaaacgtaatattggccttggggctctccagccctttgggacttccaatgggatcttagaagcagccgaagcagcgtgagggcggcagcccagggccagccacgatttgaacgctctgccttgcagctcttctggaccgaggagcccaaagccctaccctcaccattcaccaggtcctgtgggaagagcagcgtggaggtgggctgaggttagaaggtgcagagcgtggaagaagattgtgagctgagtattggacatctgttcttgaatagtccctgggcctgccataggaaaggaagttctccagggttacagttcttatccgcgtgaatacacatggctctgttacgaaaaattaatcaggtgctgctgttccttctgatcgtgaccctctgtgtgattctgtataagaaagttcataaggggactgtgcccaagaatgacgcagatgatgaatccgagactcctgaagaactggaagaagagattcctgtggtgatttgtgctgcagcagggaggatgggtgccactatggctgccatcaatagcatctacagcaacactgacgccaacatcttgttctatgtagtgggactccggaatactctgactcgaatacgaaaatggattgaacattccaaactgagagaaataaactttaaaatcgtggaattcaacccgatggtcctcaaagggaagatcagaccagactcatcgaggcctgaattgctccagcctctgaactttgttcgattttatctccctctacttatccaccaacacgagaaagtcatctatttggacgatgatgtaattgtacaaggtgatatccaagaactgtatgacaccaccttggccctgggccacgcggcggctttctcagatgactgcgatttgccctctgctcaggacataaacagactcgtgggacttcagaacacatatatgggctatctggactaccggaagaaggccatcaaggaccttggcatcagccccagcacctgctctttcaatcctggtgtgattgttgccaacatgacagaatggaagcaccagcgcatcaccaagcaattggagaaatggatgcaaaagaatgtggaggaaaacctctatagcagctccctgggaggaggggtggccacctccccaatgctgattgtgtttcatgggaaatattccacaattaaccccctgtggcacataaggcacctgggctggaatccagatgccagatattcggagcattttctgcaggaagctaaattactccactggaatggaagacataaaccttgggacttccctagtgttcacaacgacttatgggaaagctggtttgttcctgaccctgcagggatatttaaactcaatcaccatagctgatataactctacccttaaaatattccctgtatagaaatgtggaattgtccctttgtagccaactataacattgttctttatgaatattacctttgatacatatgatccacaatataaaaaccaaaaactactgtgtgcaaattataccttggaccatataggcattgattaacttctttaagtacatgtgataactatggaaatcaagattatgtgactgaaaaacataaaggaagagacccatctagataacagcaatcaacctgcttaattctgaatgacaattatatccacaaatttttaaaacttctacatgtatttttcacatgaagatctccttaacaggttgccaaccttttcttttataaaactattacatttaaaatatggacgtctgaaaaataaaatattcatcatttttatga

SEQ ID NO: 138210 - DNA, 582 bp, Homo sapiens
  Payload ID: 7071
  Gene Symbol: GLT8D2
  Gene Name: glycosyltransferase 8 domain containing 2
  ENST ID: ENST00000546851
  CDS Start-End: 385-582
aagaaacccgagacgttccgaagtcaacgcaagcaaaggggagtgcgggtcggggaggaatattcttttggaaacgtaatattggccttggggctctccagccctttgggacttccaatgggatcttagaagcagccgaagcagcgtgagggcggcagcccagggccagccacgatttgaacgctctgccttgcagctcttctggaccgaggagcccaaagccctaccctcaccattcaccagaatctgccttaggaagctgttctgaggatctccatccccccagaaagaactggccgttgtggaaacccaaatgatgaatccgagactcctgaagaactggaagaagagattcctgtggtgatttgtgctgcagcagggaggatgggtgccactatggctgccatcaatagcatctacagcaacactgacgccaacatcttgttctatgtagtgggactccggaatactctgactcgaatacgaaaatggattgaacattccaaactgagagaaataaactttaaaatcgtggaattcaacccgatggtcctcaaagggaagatcagaccagactcatcg

SEQ ID NO: 138211 - DNA, 1835 bp, Homo sapiens
  Payload ID: 7071
  Gene Symbol: GLT8D2
  Gene Name: glycosyltransferase 8 domain containing 2
  Uniprot ID: Q9H1C3
  ENST ID: ENST00000548660
  CDS Start-End: 658-1707
acaagcaacgtgagagaagctcgggtagaggttcgaagagctgggagcgcagggcggggacctcgcacgggagggtgcgggcgggagcctgcctcgcgagcccgggccacggcggctgctcccgaccgtgactgggacccgggcagggaaggtcgctacaaagcctgccgggcgaaccgaaggcagctttgtgcggagccatgccaggaagcttgggaaccgtgagccacaagagaacagcgttgttttttgcatgttttgcacttagccagaggaagtctggcgcatccgagccggccagccgagcacatctggaagtggtttctggggccgcccctctctgccagcgcaactcctgggttcccagcggcttcgcgcagaggtggaagaaacccgagacgttccgaagtcaacgcaagcaaaggggagtgcgggtcggggaggaatattcttttggaaacgtaatattggccttggggctctccagccctttgggacttccaatgggatcttagaagcagccgaagcagcgtgagggcggcagcccagggccagccacgatttgaacgctctgccttgcagctcttctggaccgaggagcccaaagccctaccctcaccattcaccaggttacagttcttatccgcgtgaatacacatggctctgttacgaaaaattaatcaggtgctgctgttccttctgatcgtgaccctctgtgtgattctgtataagaaagttcataaggggactgtgcccaagaatgacgcagatgatgaatccgagactcctgaagaactggaagaagagattcctgtggtgatttgtgctgcagcagggaggatgggtgccactatggctgccatcaatagcatctacagcaacactgacgccaacatcttgttctatgtagtgggactccggaatactctgactcgaatacgaaaatggattgaacattccaaactgagagaaataaactttaaaatcgtggaattcaacccgatggtcctcaaagggaagatcagaccagactcatcgaggcctgaattgctccagcctctgaactttgttcgattttatctccctctacttatccaccaacacgagaaagtcatctatttggacgatgatgtaattgtacaaggtgatatccaagaactgtatgacaccaccttggccctgggccacgcggcggctttctcagatgactgcgatttgccctctgctcaggacataaacagactcgtgggacttcagaacacatatatgggctatctggactaccggaagaaggccatcaaggaccttggcatcagccccagcacctgctctttcaatcctggtgtgattgttgccaacatgacagaatggaagcaccagcgcatcaccaagcaattggagaaatggatgcaaaagaatgtggaggaaaacctctatagcagctccctgggaggaggggtggccacctccccaatgctgattgtgtttcatgggaaatattccacaattaaccccctgtggcacataaggcacctgggctggaatccagatgccagatattcggagcattttctgcaggaagctaaattactccactggaatggaagacataaaccttgggacttccctagtgttcacaacgacttatgggaaagctggtttgttcctgaccctgcagggatatttaaactcaatcaccatagctgatataactctacccttaaaatattccctgtatagaaatgtggaattgtccctttgtagccaactataacattgttctttatgaatattacctttgatacatatgatccacaatataaaaaccaaaaact

SEQ ID NO: 138212 - DNA, 862 bp, Homo sapiens
  Payload ID: 7071
  Gene Symbol: GLT8D2
  Gene Name: glycosyltransferase 8 domain containing 2
  ENST ID: ENST00000547583
  CDS Start-End: 406-657
agaaacccgagacgttccgaagtcaacgcaagcaaaggggagtgcgggtcggggaggaatattcttttggaaacgtaatattggccttggggctctccagccctttgggacttccaatgggatcttagaagcagccgaagcagcgtgagggcggcagcccagggccagccacgatttgaacgctctgccttgcagctcttctggaccgaggagcccaaagccctaccctcaccattcaccaggtcctgtgggaagagcagcgtggaggtgggctgaggttagaaggtgcagagcgtggaagaagattgtgagctgagtattggacatctgttcttgaatagtccctgggcctgccataggaaaggaagttctccagggttacagttcttatccgcgtgaatacacatggctctgttacgaaaaattaatcaggtgctgctgttccttctgatcgtgaccctctgtgtgattctgtataagaaagttcataaggggactgtgcccaagaatgacgcagaatctcactctgttgccccagctcaaatacagtggcacaatagcagctccctgcagcctcgacctccagggctcaagcaatcctccggcctcagcaccccaggaagttggaactacaggataccagtcttactgggataaggcctaccaaatggcttcattttaacttatttgcctttttaaaggcaattaagtgcatggacatcctgagatgctggaagctaagacgttaacaaacggactctggaggacacaattcagtccatagcagtatctacacctcaataaactgttctaaaagagagagagagagaaggaagtcacataaagacaaatgtcatctgaa

SEQ ID NO: 138213 - DNA, 1578 bp, Homo sapiens
  Payload ID: 7071
  Gene Symbol: GLT8D2
  Gene Name: glycosyltransferase 8 domain containing 2
  Uniprot ID: Q9H1C3
  ENST ID: ENST00000546436
  CDS Start-End: 110-1159
agagatggagttatttccctagaatcacacgatcataatggcttgtataagtggggttccaactgtttgccaagtactgttgttacagttcttatccgcgtgaatacacatggctctgttacgaaaaattaatcaggtgctgctgttccttctgatcgtgaccctctgtgtgattctgtataagaaagttcataaggggactgtgcccaagaatgacgcagatgatgaatccgagactcctgaagaactggaagaagagattcctgtggtgatttgtgctgcagcagggaggatgggtgccactatggctgccatcaatagcatctacagcaacactgacgccaacatcttgttctatgtagtgggactccggaatactctgactcgaatacgaaaatggattgaacattccaaactgagagaaataaactttaaaatcgtggaattcaacccgatggtcctcaaagggaagatcagaccagactcatcgaggcctgaattgctccagcctctgaactttgttcgattttatctccctctacttatccaccaacacgagaaagtcatctatttggacgatgatgtaattgtacaaggtgatatccaagaactgtatgacaccaccttggccctgggccacgcggcggctttctcagatgactgcgatttgccctctgctcaggacataaacagactcgtgggacttcagaacacatatatgggctatctggactaccggaagaaggccatcaaggaccttggcatcagccccagcacctgctctttcaatcctggtgtgattgttgccaacatgacagaatggaagcaccagcgcatcaccaagcaattggagaaatggatgcaaaagaatgtggaggaaaacctctatagcagctccctgggaggaggggtggccacctccccaatgctgattgtgtttcatgggaaatattccacaattaaccccctgtggcacataaggcacctgggctggaatccagatgccagatattcggagcattttctgcaggaagctaaattactccactggaatggaagacataaaccttgggacttccctagtgttcacaacgacttatgggaaagctggtttgttcctgaccctgcagggatatttaaactcaatcaccatagctgatataactctacccttaaaatattccctgtatagaaatgtggaattgtccctttgtagccaactataacattgttctttatgaatattacctttgatacatatgatccacaatataaaaaccaaaaactactgtgtgcaaattataccttggaccatataggcattgattaacttctttaagtacatgtgataactatggaaatcaagattatgtgactgaaaaacataaaggaagagacccatctagataacagcaatcaacctgcttaattctgaatgacaattatatccacaaatttttaaaacttctacatgtatttttcacatgaagatctccttaacaggttgccaaccttttcttttataaaactattacatttaaaatatggacgtctgaaaaataaaatattcatcatttt

SEQ ID NO: 138214 - DNA, 2522 bp, Homo sapiens
  Payload ID: 7072
  Gene Symbol: GYLTL1B
  Gene Name: glycosyltransferase-like 1B
  Uniprot ID: Q8N3Y3
  ENST ID: ENST00000325468
  CDS Start-End: 106-2271
gccgcccagggctgagtctcccatctcgcccctcggtccgcagggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcggtggggacctggggtgtgagcgccgcgagcctggcgggcgagcgggggccccgggatgcttccccggcccgctcatgccacgtgtccccccagacgggaggctgcggagagccgccgccctcgacggagacccgggggccggccccggggaccacaaccgctccgactgcggcccgcagccgccgccgccgcccaagtgcgagctcttgcatgtggccatcgtgtgtgcggggcataactccagccgagacgtcatcaccctggtgaagtccatgctcttctacaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctgacacgcaggcgatcggtcttgtggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcctgccacctcactggctgaccaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcagggcctccattgagcagctggggctgggcagccggcgcaaggcagcactggtggtgccggcattcgagaccctgcgctaccgcttcagcttcccccattccaaggtggagctgttggccttgctggatgcgggcactctctacaccttcaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggaatatgagctcctggtgctgcccgaggccttcaccatccatctgccccacgctccaagcctggacatctcccgcttccgctccagccccacctatcgtgactgcctccaggccctcaaggacgaattccaccaggacttgtcccgccaccatggggctgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaacatc

SEQ ID NO: 138215 - DNA, 2516 bp, Homo sapiens
  Payload ID: 7072
  Gene Symbol: GYLTL1B
  Gene Name: glycosyltransferase-like 1B
  Uniprot ID: Q8N3Y3
  ENST ID: ENST00000401752
  CDS Start-End: 100-2265
gcgagcgcagggcccagcccgggagccgctggagcagggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcggtggggacctggggtgtgagcgccgcgagcctggcgggcgagcgggggccccgggatgcttccccggcccgctcatgccacgtgtccccccagacgggaggctgcggagagccgccgccctcgacggagacccgggggccggccccggggaccacaaccgctccgactgcggcccgcagccgccgccgccgcccaagtgcgagctcttgcatgtggccatcgtgtgtgcggggcataactccagccgagacgtcatcaccctggtgaagtccatgctcttctacaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctgacacgcaggcgatcggtcttgtggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcctgccacctcactggctgaccaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcagggcctccattgagcagctggggctgggcagccggcgcaaggcagcactggtggtgccggcattcgagaccctgcgctaccgcttcagcttcccccattccaaggtggagctgttggccttgctggatgcgggcactctctacaccttcaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggaatatgagctcctggtgctgcccgaggccttcaccatccatctgccccacgctccaagcctggacatctcccgcttccgctccagccccacctatcgtgactgcctccaggccctcaaggacgaattccaccaggacttgtcccgccaccatggggctgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaacatc

SEQ ID NO: 138216 - DNA, 2459 bp, Homo sapiens
  Payload ID: 7072
  Gene Symbol: GYLTL1B
  Gene Name: glycosyltransferase-like 1B
  ENST ID: ENST00000529052
  CDS Start-End: 136-2208
aagcaaacaacttcaactttccatgagtgctagccagccctgggaggctccgctgccagaaggaacgtcaaggggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcgacgggaggctgcggagagccgccgccctcgacggagacccgggggccggccccggggaccacaaccgctccgactgcggcccgcagccgccgccgccgcccaagtgcgagctcttgcatgtggccatcgtgtgtgcggggcataactccagccgagacgtcatcaccctggtgaagtccatgctcttctacaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctgacacgcaggcgatcggtcttgtggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcctgccacctcactggctgaccaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcagggcctccattgagcagctggggctgggcagccggcgcaaggcagcactggtggtgccggcattcgagaccctgcgctaccgcttcagcttcccccattccaaggtggagctgttggccttgctggatgcgggcactctctacaccttcaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggaatatgagctcctggtgctgcccgaggccttcaccatccatctgccccacgctccaagcctggacatctcccgcttccgctccagccccacctatcgtgactgcctccaggccctcaaggacgaattccaccaggacttgtcccgccaccatggggctgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaacatc

SEQ ID NO: 138217 - DNA, 2528 bp, Homo sapiens
  Payload ID: 7072
  Gene Symbol: GYLTL1B
  Gene Name: glycosyltransferase-like 1B
  Uniprot ID: Q8N3Y3
  ENST ID: ENST00000531526
  CDS Start-End: 112-2277
gagtgctagccagccctgggaggctccgctgccagaaggaacgtcaaggggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcggtggggacctggggtgtgagcgccgcgagcctggcgggcgagcgggggccccgggatgcttccccggcccgctcatgccacgtgtccccccagacgggaggctgcggagagccgccgccctcgacggagacccgggggccggccccggggaccacaaccgctccgactgcggcccgcagccgccgccgccgcccaagtgcgagctcttgcatgtggccatcgtgtgtgcggggcataactccagccgagacgtcatcaccctggtgaagtccatgctcttctacaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctgacacgcaggcgatcggtcttgtggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcctgccacctcactggctgaccaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcagggcctccattgagcagctggggctgggcagccggcgcaaggcagcactggtggtgccggcattcgagaccctgcgctaccgcttcagcttcccccattccaaggtggagctgttggccttgctggatgcgggcactctctacaccttcaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggaatatgagctcctggtgctgcccgaggccttcaccatccatctgccccacgctccaagcctggacatctcccgcttccgctccagccccacctatcgtgactgcctccaggccctcaaggacgaattccaccaggacttgtcccgccaccatggggctgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaacatc

SEQ ID NO: 138218 - DNA, 476 bp, Homo sapiens
  Payload ID: 7072
  Gene Symbol: GYLTL1B
  Gene Name: glycosyltransferase-like 1B
  ENST ID: ENST00000534410
  CDS Start-End: 1-476
tggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcagggcctccattgagcagctg

SEQ ID NO: 138219 - DNA, 501 bp, Homo sapiens
  Payload ID: 7072
  Gene Symbol: GYLTL1B
  Gene Name: glycosyltransferase-like 1B
  ENST ID: ENST00000531847
  CDS Start-End: 1-329
ccttgctggatgcgggcactctctacaccttcaggaatatgagctcctggtgctgcccgaggccttcaccatccatctgccccacgctccaagcctggacatctcccgcttccgctccagccccacctatcgtgactgcctccaggccctcaaggacgaattccaccaggacttgtcccgccaccatggggctgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaacatc

SEQ ID NO: 138220 - DNA, 1346 bp, Homo sapiens
  Payload ID: 7072
  Gene Symbol: GYLTL1B
  Gene Name: glycosyltransferase-like 1B
  ENST ID: ENST00000536139
  CDS Start-End: 404-1177
ttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgagggcccctataccccgtcaaccagcttcgcaacgtggccttggccaggccctcacgccttacgtcttcctcagtgacattgacttcctgcctgcctattctctctacgactacctcagggcctccattgagcagctggggctgggcagccggcgcaaggcagcactggtggtgccggcattcgagaccctgcgctaccgcttcagcttcccccattccaaggtggagctgttggccttgctggatgcgggcactctctacaccttcaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggaatatgagctcctggtgctgcccgaggccttcaccatccatctgccccacgctccaagcctggacatctccgcttccgctccagccccacctatcgtgactgcctccaggccctcaaggacgaattccaccaggacttgtcccgccaccatggggctgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaac

SEQ ID NO: 138221 - DNA, 2356 bp, Homo sapiens
  Payload ID: 7073
  Gene Symbol: GTDC1
  Gene Name: glycosyltransferase-like domain containing 1
  Uniprot ID: Q4AE62
  ENST ID: ENST00000241391
  CDS Start-End: 89-1219
attgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtgggagcatgataaagatccagaaagcttttttaaggtattaatgcatcttaaagacttaggactcaatttccacgtgtctgtacttggagaaaccttcacagatgtcccaggttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaattttt

SEQ ID NO: 138222 - DNA, 2607 bp, Homo sapiens
  Payload ID: 7073
  Gene Symbol: GTDC1
  Gene Name: glycosyltransferase-like domain containing 1
  Uniprot ID: Q4AE62
  ENST ID: ENST00000344850
  CDS Start-End: 195-1571
atatggttgtctgagagcatcagaaaagaacctgctctggtcaggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtgggagcatgataaagatccagaaagcttttttaaggtattaatgcatcttaaagacttaggactcaatttccacgtgtctgtacttggagaaaccttcacagatgtcccagatattttttcagaggccaaaaaggcattgggatcttctgtcttacactggggctacttacccagcaaagatgactatttccaagtactgtgcatggctgatgttgtcatctcaacagctaagcatgaattctttggagtggcaatgttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaattttt

SEQ ID NO: 138223 - DNA, 2408 bp, Homo sapiens
  Payload ID: 7073
  Gene Symbol: GTDC1
  Gene Name: glycosyltransferase-like domain containing 1
  Uniprot ID: Q4AE62
  ENST ID: ENST00000392867
  CDS Start-End: 249-1370
aggtctggctagctgtccctaacgtcatttcctggtctcaactctttaagaccctgacatactctgagattggagtgaagatttctgtgacatgctgggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtggttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaatttttaa

SEQ ID NO: 138224 - DNA, 10514 bp, Homo sapiens
  Payload ID: 7073
  Gene Symbol: GTDC1
  Gene Name: glycosyltransferase-like domain containing 1
  Uniprot ID: Q4AE62
  ENST ID: ENST00000392869
  CDS Start-End: 154-1530
caggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtgggagcatgataaagatccagaaagcttttttaaggtattaatgcatcttaaagacttaggactcaatttccacgtgtctgtacttggagaaaccttcacagatgtcccagatattttttcagaggccaaaaaggcattgggatcttctgtcttacactggggctacttacccagcaaagatgactatttccaagtactgtgcatggctgatgttgtcatctcaacagctaagcatgaattctttggagtggcaatgttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaatttttaattagcatattcatttacatatagatgtatacatctacctatgtgtttctcactgaacgttttccttgtgacagagacaacaaatacaattgtttcttttccggatgaacaaggatctgttttgcaaatgtttgtaagatattatgacatttccaagattttctttgcattctggaaagcaggaggtaaacatttgtagtcattaaggtaaagtctgttgataaaccatcttctgtttactgacaggtaaattgtaactttccctagcttttgaaatgagtaacttctatacaccacaaagtgaggcacagcctgggaaaggtggctagacaaggggcaagccaggctttctagcttctggaaggatcgagtggcctagcaggcatctaagataaagaaagcaatgattcggaagtccagtagggcccatttgaccggtagcaaaatcgaaagcacgaaatagatcaaggttagggagccagacaaagcccttggaagagaggcagtattgcagatcgaagcaagcagttcagagtctatgaggcctgggaatttaaaagcaggaagagtaagaagcagaaacaagaagctccatctgaacagactcctctctccaaccttcatgagacccacagtgtgtgatgggccaccacagcactggcttctagacttttacagggaagccagtgaacaaattacctcgtcacccagaaaacaaagagctcaggaactattttggaagttccttccagtctaagactatggaactcagaatctagcaggtgtgttcctttggatagcaaaactaaagatataaatatgaataagaaattctttgccacttctcctgggcaaggttatactttatgccatctactgagataaaccagatgagtcagtttgcttctgtcagttgctgtgtcacagatgacatcttctcaaaataatattatctcacagccaagaaatagcgcttcgtttactgtgtttttctatcctgaaactaaatgggcttacgcttcatagtggctaagatactccacacacaactagtacccatagatcttttctcactgataggaaaaaaaaaaaaaaagcattaaacacctttcagagagtacatctgaaacatttacgtattttcctgatttaggcaaatataatattgaaagttacctgtatgtgggcatttttttctacactcataaatgcaaatcaaattttgccattagctgtggccaacattccttccaggacaaaagcttacattaggccgggtgcggtggcgcacgcctgtaatcccagcactttgggaggccgagacgggtggatcatgaggtcaggagatcgagaccatcctggctaacacggtgaaaccccatctctactaaaaatacaaaaaaaattagccaggcatggtggcgggtgcctgtagtcccagctactggggaggctgaggcaggagaatggcgtgaacccaggaggcggagcttgcagtgagccgagatcgtgccactgcactccagcctgggcgacagagcgagactctgtctcaaaaaataaataaataaataaatttaaaataaattttaaaaaaattacattaaaggtgtcacttatttgcatgataccgagatttggagtttaaagaaaaaccttataaagactgtaatgtcagagttgctactagttcacataagcaataaaaagttttgtaaatgtgtaattcttaacatttaaaaatatgtaggagtgtgtgtgtgtgtgtgtgtgtgcacacgcacattcatgcttctcaacacccacgacctagtggaatggagtgttattaaataagttaatcagtattttgttgaaatctcagcagataattagtactacacgttgactcattaattcagtttcccttatcaaccacccccatcatttattgttttgagtatgtttgatggaaaacttagtcttcctctttttttttaacactcgattgtttttttcttttaaaataaagtcaattttaattttaaatgtctttaaaagtccatccattatcaagactttgacacagtgtcttgaaatacagcttgccctaaacttaatctatgcttctggctaggtgtttctataacaaatatcagggcacctggttcttaaccttctcatttatactgtgttgacagaaatagatgcaaatacctttttaaaaatgctcctggtttaataagcatccttcaaatacagttaagtttaaatgccctgctcctgttctcagtccttcagacatcaatatggcaggcagaatccataagtcaatggaaactcttagccatagagggctgcagagattaatttcaacaccttgaaatgcatctggaagcaaagatttcattttatgttgaaggtgttaattatatttgatatttttaaaagtaaaatctgtttttgagaaagcatctgctacccagaaatattatgagccacaaaagaaattttactgaagtctcaagatactttctgtggatgatagaatcagttttcaaatgatagtccatgctgtcttttaatgctgacatacactgtgggtcttattcttctattgactattgacccaactgcctttctttttcagtggaaaatttgggactatttaatattagatcttatgtttaacaatgaagagagtatattataaaccactgacttgaacatgtttcattttaaaatttgagttgtgatacagacaactaatgctcctatcctatgccctctcttcaaagctattcattaaaatataactggggaagtttgaaaaacatgcgagcaattctacatgctgctcaaagatacagacatgtgtgattaaagtacagtattacagaaaacctgggaattaaccaaacttacaataatggttatgtcagaggggccatggtagagaaaaaaaaggacatagaagtagggaaaggtgcattcgttgcatgatgagaagtctgtttcttaagctgagtcgtgatacacaaaggcttcttgccactctttgtgacatttcatgtgtcttcagtgtatttattgcatatatcttttgataggagatataaatacttcaggaagcatgttactagttttgctatcaggctatccttaacatttcttggttttctcaattattgattgagtcagaaaactgcttgcctcagacagtgatacaaactactctactgccaatgttgcttgagaagactttcctctgcttaacaggagccaggggcttcacctcaaccctcatgctgtggagaaagtcagactcaactggccacaggttcctgtttcttggggctgctaatcaccatttctaacagatgcctgtggcattgcaaacacaagatggaaaactatagctctaaactcccttctgaagggtaaggaaaggaagaggaaggcagatgttaaatgagcccagtctttctcatctcaaaaaattcagagctgcctgttagagcacaagagctctcagagctcccaaccacactgcccactccccatagtgttgcctctcccctttcctctttaagacgcaggagcgaatcgtggtctttgtgctttcactgcaatctatcccaggggaagagttctcccgggtatctgtgggatgcccttgctgcatgtgaggcacaaatggcttcagggaccaggatcctcactcactctgcagtccatttttctaaattggaatttgcgatcggtttcttcaggtgtcccaccatcatctatcattatctgagttattccttatcctctcccaaccccaaggagaggatcttaattgtttttataaactgacagaaggaattggtgattcttggaagataattttaaatggttatattactttcctattactgcatttactgcatttaaatagcaggtctaaggtggggtgcgagaagatgtgacccctaggaatattggtatgacctttctcaagcaatttgaagtcctttagatctgaaaatttaatgtcttcaatatcatttcacagatgagaaaattaaggcacatatagtgacatatttaggagctgaagtgtgttacagaaacaaagtttttttgtataagcctttccctacatgggatgttatcattgtcacctatgtgcctttcaggaagcaccaagtgcagtatgcgtgactcagttggacccctagttcccttctatttctccagctggcaggagacagcaaaggacagtggaggtggttattttgtggcccacatttctgccattaaaagggacataagagactatgtagtgtggccaatttttttttttttttttttgagagagagagtctggctctgtcgcccaggctggagtgcagtggcaccatctcggctcactgcaagctccacctcccgggttcacgccattctcctgcctcagcctcccgagtagctgggactacaggtgcccaccaccacgcccggctaatttttttgtatttttagtagagacggggtttcaccatgttagccagggtggtctcaatctcctgacctcgtgatccacctgtctcggcctcccaaagtgctgggattacaggtgtaagccaccatgcccggaatatggccattattttaagtgtttttattattgctctggttctccctttagggaggcattcagtgagtataccccatctgtcacaggcccccaccactccctgtggtcttacactctgctgaattcatacatttaggtaacttccctggccctcctgagaatcacttatttttgtaacctcctgtatttgagatgtaggaaactggggcctgaggagaagttgacttgccttgggtcccacagtggtacaggcagatctagaactcagattttccagggctctttcagtaggctgtggttgagcagtagtcaagaccacctcttcaagaagggaaaaacatttgtcttctctttctcctctttcttccttctgcctctcactgtaagaagaaacgtgttaataagttgctaataccttactctaggtgtatttcatgttacaccagccagtgcttgtattctcaatgaccataaggagaggaatgcggaagaattgatttctgtactaaaagttcagactctgtggcacttgtgatatttctggacaactgactcttctctattgcctttcgaatcatacagtggcaaagctgctcacccatgtgtgtataaagctgacccttcatcagaaaggcagcccccagtgtctccccacacagggcagaagagcagagggagcaggtggcaatgtggcagcaccttgaactgtgcatcactgggcctgctccccctcatcccaaagcaataacccagaaattacatcctgagacttacttcctcagaaagaaaaggaaggggagggataacttaaaaaggagaaacttctaatatggtattagactgtaattcatagggaaatttatgcctgagatatgaatttctgaaaataaggggcttttttggaagggaaacactgacacatccttaattatagagtaataaataccaatggtatattatctttcgatatttccttacacagatatcaaagcatgcagctgtttttgaaaactgataatcaagtacaatataagtatattacatcttgcacttacaacacacccttcaactaagcagcatcatggagcacttaacggtgagaaacagagctgctcatagtagaaacctaactgaacaaattagctttgaattgtaacttaagaatcgtagtcaaaccaaagcgtctgtccttgccaggaaaggcattccaaaggcagagagcatgccaagtaaaaaggctttgcttcaggattatggagacagttctgaaaagccagcataacttaatgatcaatcagaaaaatatagagcagtaactacacaactgaaggatgcataaaaattgtacaaaacgttaatagtggaatggggaggtaggatgggattttacgggcaagtattaagctcttggaaagcttcatttgttgccctcaatccacacagcagaaagaaagagaaagagacaaacatggtcaaagaaaagtatgtggacaaatgtggggggtagaaaaggaaatgaaggttaagcaaggccaatataattcagaataaaagggagggagggaagtataaggagccagctgtaattactgaatgttacattaagaagagctgaaattgagagggggaggtcttgagtattttactaagtggattaatgtcctcttcctcgggtgtctgaagttgcagattttaatttatttggtgcagggatttattacagaattcttaatgggtggggagataaacagggacaattataagctcttaagaagaagaaaagaggaccatataatactttctataaatttaactgtaataaacagggtttcaagctatggacaaagatagtcaaaaaaagcatttattccatgatataggactaaaagggaaataagaggtgtgtccaaaaaacttaaagaccaaaacaaagaaagaaaaacccacatagatgtgtgatgccaggattttgaatgacttgggagctagttattgccgctctcctttctccacccatttaaaaaaataaatcataactctggcatttaaaaacctactcatgaacatcatttattaatataaacttaatcctgtgctattctttggtgggtggtaagaacatgaattaacaacaactggactaaaacgatggcaacaggatgatccactcaaacacaggaaagctgtaagaaaaagaaaaactcctaatctgctctttcaccttacttattttacagaaggagaaagccaaaaaggggagagcatgtggctaaaccacagaaagactagatgcctaaaggaaaaattttaaagtgttcctaaataggtattagaaggggaagggggatgtaaagcttatgtgatttacatcattttgttaatctgctaatctacttccctggaaggtgagaaagagtgttgtctgccttctgcaattgaagagactagggcagaaacttaattatgttcttaccctgtgtatacctggctgtcatctggctggcaactagtccacaaactattggttcaggcatttgcctggcaataatgttagccatcatttaaattgttaaatatggatcagaagatctctaagaattactgatatgcagctattaatactggatgtaaataatattatttggggtgtgggtaaatcatttgactggaaccacatttaaaaaaaggacttggaaattttatttttgaaatgctgttggggagatggcattgatgaaaaaaaaaattgaaaatggaaaaaaacatcatctacaaagagatgggtaaaaatgactaagcaaagaagccttgtcaccttcgacctgatgcttcattgtatcagaagaaagtaaacagattgctaacaaagagaccaccccttctaatttccaaaaccggcccagcaacaagagggagaaaatagagaagagtgcactgcgtggtggctcagggtgatcctttaatttgagtgttaaaaatgagggcacagacctagaggtttttaatggtccgcgggtggacttcagattctgaacactcctccaccttctgtggagaattcgggacacggtggagtttaaccagtatcttaaatcccagggacagggtggagattgctttgtgatcctgattaattaaaaggaaagaaatcaaagcagacatctctcctttttccatttgagccgcagagccatggaggggaacttgtgctctctggtgcttgcagctatgttccctggctttcatcgtcttggcttttccccttgtatttctaatgctgtgataccaggccaataaaatggaatctacaaaactgcaaaacaaaa

SEQ ID NO: 138225 - DNA, 2352 bp, Homo sapiens
  Payload ID: 7073
  Gene Symbol: GTDC1
  Gene Name: glycosyltransferase-like domain containing 1
  Uniprot ID: Q4AE62
  ENST ID: ENST00000392871
  CDS Start-End: 92-1222
cagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtgggagcatgataaagatccagaaagcttttttaaggtattaatgcatcttaaagacttaggactcaatttccacgtgtctgtacttggagaaaccttcacagatgtcccaggttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgc

SEQ ID NO: 138226 - DNA, 2954 bp, Homo sapiens
  Payload ID: 7073
  Gene Symbol: GTDC1
  Gene Name: glycosyltransferase-like domain containing 1
  Uniprot ID: Q4AE62
  ENST ID: ENST00000409214
  CDS Start-End: 280-1656
ggacttgctggagatatagaaagggacctgacacagtttctggccttaaggagctctcattccagtggggaagaaaaaaactaaaataatgatgtccgagagcatcagaaaagaacctgctctggtcaggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtgggagcatgataaagatccagaaagcttttttaaggtattaatgcatcttaaagacttaggactcaatttccacgtgtctgtacttggagaaaccttcacagatgtcccagatattttttcagaggccaaaaaggcattgggatcttctgtcttacactggggctacttacccagcaaagatgactatttccaagtactgtgcatggctgatgttgtcatctcaacagctaagcatgaattctttggagtggcaatgttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaatttttaattagcatattcatttacatatagatgtatacatctacctatgtgtttctcactgaacgttttccttgtgacagagacaacaaatacaattgtttcttttccggatgaacaaggatctgttttgcaaatgtttgtaagatattatgacatttccaagattttctttgcattctggaaagcaggaggtaaacatttgtagtcattaaggtaaagtctgttgataaaccatcttctgtttactgacaggtaaattgtaacttt

SEQ ID NO: 138227 - DNA, 2209 bp, Homo sapiens
  Payload ID: 7073
  Gene Symbol: GTDC1
  Gene Name: glycosyltransferase-like domain containing 1
  ENST ID: ENST00000409298
  CDS Start-End: 151-1173
gtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagggagcatgataaagatccagaaagcttttttaaggtattaatgcatcttaaagacttaggactcaatttccacgtgtctgtacttggagaaaccttcacagatgtcccagatattttttcagaggccaaaaaggcattgggatcttctgtcttacactggggctacttacccagcaaagatgactatttccaagtactgtgcatggctgatgttgtcatctcaacagctaagcatgaattctttggagtggcaatgttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaattttt

SEQ ID NO: 138228 - DNA, 586 bp, Homo sapiens
  Payload ID: 7073
  Gene Symbol: GTDC1
  Gene Name: glycosyltransferase-like domain containing 1
  ENST ID: ENST00000429978
  CDS Start-End: 281-481
aggcggccgcgggccgggaggggcggcggcatccgcggcggccgcgggggaggggcacggcgtcagcgcgtcgccggctgggccgcgccggtggccaggagggagagacaaggaggaggaggaggaggaggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggcaatcagaaattacaaattaggaaacaggagagatgagaatggaatgttaaccttttggtatgaagcaggtcaacattgaaaatgcaagaagcctggatccagcttcctgaaaagaagctccttgg

SEQ ID NO: 138229 - DNA, 601 bp, Homo sapiens
  Payload ID: 7073
  Gene Symbol: GTDC1
  Gene Name: glycosyltransferase-like domain containing 1
  ENST ID: ENST00000417450
  CDS Start-End: 303-601
aggtgacactgatgataaaaatccatccaagaatttatatgtgacatctgcagcaggttcaaatctctcagctatgagacaaactggatacttcctaaggattgccatctattatgcacagagagccaaaatccgttactgaaattgtctgggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaa

SEQ ID NO: 138230 - DNA, 2780 bp, Homo sapiens
  Payload ID: 7073
  Gene Symbol: GTDC1
  Gene Name: glycosyltransferase-like domain containing 1
  ENST ID: ENST00000415569
  CDS Start-End: 153-353
aggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggcaatcagaaattacaaattaggaaacaggagagatgagaatggaatgttaaccttttggtatgaagcaggtcaacattgaaaatgcaagaagcctggatccagcttcctgaaaagaagctccttgataaagaggattgatgtcttcacatgttgactcttcatgtctggatatggtttggatttatgccttgcccaaatctcatgcagaattataatcaccaatgttgcaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtgggagcatgataaagatccagaaagcttttttaaggtattaatgcatcttaaagacttaggactcaatttccacgtgtctgtacttggagaaaccttcacagatgtcccagatattttttcagaggccaaaaaggcattgggatcttctgtcttacactggggctacttacccagcaaagatgactatttccaagtactgtgcatggctgatgttgtcatctcaacagctaagcatgaattctttggagtggcaatgttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaag

SEQ ID NO: 138231 - DNA, 753 bp, Homo sapiens
  Payload ID: 7073
  Gene Symbol: GTDC1
  Gene Name: glycosyltransferase-like domain containing 1
  ENST ID: ENST00000437114
  CDS Start-End: 233-753
gtatctctgcattagccagattggacatatgtaaagggacatcagtatatctggatcatcagtggtataatgtgttatagaggtggacaagcctgcagattgaagtggggatcgtccagattgttcccttccctggaccatatgattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcag

SEQ ID NO: 138232 - DNA, 1563 bp, Homo sapiens
  Payload ID: 7073
  Gene Symbol: GTDC1
  Gene Name: glycosyltransferase-like domain containing 1
  Uniprot ID: Q4AE62
  ENST ID: ENST00000463875
  CDS Start-End: 349-1338
gggcacggcgtcagcgcgtcgccggctgggccgcgccggtggccaggagggagagacaaggaggaggaggaggaggaggtatctctgcattagccagattggacatatgtaaagggacatcagtatatctggatcatcaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtgggagcatgataaagatccagaaagcttttttaaggtattaatgcatcttaaagacttaggactcaatttccacgtgtctgtacttggagaaaccttcacagatgtcccagatattttttcagaggccaaaaaggcattgggatcttctgtcttacactggggctacttacccagcaaagatgactatttccaagtactgtgcatggctgatgttgtcatctcaacagctaagcatgaattctttggagtggcaatgttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagaga

SEQ ID NO: 138233 - DNA, 2677 bp, Homo sapiens
  Payload ID: 7073
  Gene Symbol: GTDC1
  Gene Name: glycosyltransferase-like domain containing 1
  Uniprot ID: Q4AE62
  ENST ID: ENST00000542155
  CDS Start-End: 265-1641
gcggcggccgcgggggaggggcacggcgtcagcgcgtcgccggctgggccgcgccggtggccaggagggagagacaaggaggaggaggaggaggaggtatctctgcattagccagattggacatatgtaaagggacatcagtatatctggatcatcaggaatcatctttcttccagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtgggagcatgataaagatccagaaagcttttttaaggtattaatgcatcttaaagacttaggactcaatttccacgtgtctgtacttggagaaaccttcacagatgtcccagatattttttcagaggccaaaaaggcattgggatcttctgtcttacactggggctacttacccagcaaagatgactatttccaagtactgtgcatggctgatgttgtcatctcaacagctaagcatgaattctttggagtggcaatgttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaattttt

SEQ ID NO: 138234 - DNA, 2317 bp, Homo sapiens
  Payload ID: 7073
  Gene Symbol: GTDC1
  Gene Name: glycosyltransferase-like domain containing 1
  Uniprot ID: Q4AE62
  ENST ID: ENST00000618778
  CDS Start-End: 1-1281
atgttgactcttcatgtctggatatggtttggatttatgccttgcccaaatctcatgcagaattataatcaccaatgttgcaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtgggagcatgataaagatccagaaagcttttttaaggtattaatgcatcttaaagacttaggactcaatttccacgtgtctgtacttggagaaaccttcacagatgtcccagatattttttcagaggccaaaaaggcattgggatcttctgtcttacactggggctacttacccagcaaagatgactatttccaagtactgtgcatggctgatgttgtcatctcaacagctaagcatgaattctttggagtggcaatgttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaattttt

SEQ ID NO: 138235 - DNA, 2634 bp, Homo sapiens
  Payload ID: 7074
  Gene Symbol: GARS
  Gene Name: glycyl-tRNA synthetase
  Uniprot ID: P41250
  ENST ID: ENST00000389266
  CDS Start-End: 242-2461
gcaaatctgttcgctcgcaaccctacctacctctctcccgaaccggagaaaaccttcggcggggtccttccgggttttgtgtcgaatctgcggcggcgacccggcgccgcgtcacgcggtggtgaatgtgcggcagcacgcgcgccgcgtcgtttacgcggcgatttcatcatgctccgagccgggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctgctccgccggtccctcagcgcggcctcctgccccccgatctccttgcccgccgccgcctcccggagcagcatggacggcgcgggggctgaggaggtgctggcacctctgaggctagcagtgcgccagcagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactgaagggaaaacatttcagttaacaaaagacatgatcaatgtgaagagattccagaaaacactatatgtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaaactactcttatgtccactttacaaaagaaaacagcattgtgattactcccagggaccgtattttatcttcagtggctgcctgattttacccccacaattaaagttgaaggaatcctgaacaaa

SEQ ID NO: 138236 - DNA, 814 bp, Homo sapiens
  Payload ID: 7074
  Gene Symbol: GARS
  Gene Name: glycyl-tRNA synthetase
  ENST ID: ENST00000454308
  CDS Start-End: 82-321
gcgatttcatcatgctccgagccgggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctgctccgccggtccctcagcgcggcctcctgccccccgatctccttgcccgccgccgcctcccggagcagcatggacggcgcgggggctgaggaggtgctggcacctctgaggctagcagtgcgccagcaggccgtttggaaccagtgagccctcagatcgtaaacctgggaaactaagtgttgcggagtgaagtcagccatccttagtatggaatattttgacatttgattttcccgaagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaa

SEQ ID NO: 138237 - DNA, 619 bp, Homo sapiens
  Payload ID: 7074
  Gene Symbol: GARS
  Gene Name: glycyl-tRNA synthetase
  ENST ID: ENST00000444666
  CDS Start-End: 1-234
gttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactgaagggaaaacatttcagttaacaaaagacatgatcaatgtgaagagattccagaaaacactatatgaacaaattctgtgaattaggcaatgagtaatttggagcacgtatgaaggatgctgaagtttatttgtggctgaattgaaattcctggaaacggagtagtaatgggtgtttgagaagctactgccagtggaaagatggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcgg

SEQ ID NO: 138238 - DNA, 324 bp, Homo sapiens
  Payload ID: 7074
  Gene Symbol: GARS
  Gene Name: glycyl-tRNA synthetase
  ENST ID: ENST00000627489
  CDS Start-End: 85-324
gcggcgatttcatcatgctccgagccgggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctgctccgccggtccctcagcgcggcctcctgccccccgatctccttgcccgccgccgcctcccggagcagcatggacggcgcgggggctgaggaggtgctggcacctctgaggctagcagtgcgccagcaggccgtttggaaccagtga

SEQ ID NO: 138239 - DNA, 1809 bp, Homo sapiens
  Payload ID: 7075
  Gene Symbol: GLOD4
  Gene Name: glyoxalase domain containing 4
  Uniprot ID: Q9HC38
  ENST ID: ENST00000301328
  CDS Start-End: 25-966
tgacggctgcgtgcggcgggaatcatggctgctcgcagagctctgcacttcgtattcaaagtgggaaaccgcttccagacggcgcgtttctatcgggacgtcctggggatgaaggtggagtcttgctctgtcgccaggctggagtgcagtggcgcgatctcggctcactgctctgactacacccggataacagaagacagtttctcaaagccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctgaaaaaaaaggttttgaaaatgttttcttgtagttttgtttggttctaaacaacaaataggttttaatcactcgaaatggaattatattgtgtattcattgaataaattttttttgaaagtaa

SEQ ID NO: 138240 - DNA, 2059 bp, Homo sapiens
  Payload ID: 7075
  Gene Symbol: GLOD4
  Gene Name: glyoxalase domain containing 4
  Uniprot ID: Q9HC38
  ENST ID: ENST00000301329
  CDS Start-End: 87-983
gtcggcggctagtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctgaaaaaaaaggttttgaaaatgttttcttgtagttttgtttggttctaaacaacaaataggttttaatcactcgaaatggaattatattgtgtattcattgaataaattttttttgaaagtaagcttctgaaatcaagctgtgataccagtctctaagtctcatcatgtaaagtggtggccaggttcagatttttaaaaataaacttaggagattggaagggattgactcagaggatcctggttcccaaagaacacatagagaattacttgtaaatcgtaacctctgctttcctcccttactggcagggcgtagggcatcgaaattttggttgtatttgagcttatcttcttatag

SEQ ID NO: 138241 - DNA, 2497 bp, Homo sapiens
  Payload ID: 7075
  Gene Symbol: GLOD4
  Gene Name: glyoxalase domain containing 4
  ENST ID: ENST00000536578
  CDS Start-End: 126-1634
cactccagcctgggtgacagaacaagacaaaaaaaaaaaaagatacactgggtaatcactaacccattattccttgtggcgttacgaggtcggaccaatccttgatatcctcaaatttcaccttaatgaggctgacacctttcagcttatcgactggcaactcctttaggtattctagacggctaaagaagaacatttttggcacagctccagccttgagagcgtctgaaatgagcctgcgaccttccagcaggatcttcccttgtttttcccgaaatggcctggactttactattgtcattacactgcctcctgtccccgggataagctttatcgtagcgaagcccagactcttcccaggtgctgggagcgcgggatgcggactcctcgagcggttgtttctctcgttgctcctgggcactggcctcagatggtgcttgcggggctgcttcccaggagcgcgcttctgttccaccacctctccggaaggaaacaccactttcactgggctccgccgcagcgcccggacccagcgcctcgcgcaaggtcccaagcctggaccacctgcagcaacggtcgcacgacaaacctcgcgggtctcaccagcgccgccatgttccctgagacccgggctgcgtcacgaaagcgcgccgtcggcggctagtgacgtcacggcccgtggcgcccttcgtggactgggctgtacggtgcgcgtgacggctgcgtgcggcgggaatcatggctgctcgcagagcctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctgaaaaaaaaggttttgaaaatgttttcttgtagttttgtttggttctaaacaacaaataggttttaatcactcgaaatggaattatattgtgtattcattgaataaattttttttgaaagtaagcttctgaaatcaagctgtg

SEQ ID NO: 138242 - DNA, 853 bp, Homo sapiens
  Payload ID: 7075
  Gene Symbol: GLOD4
  Gene Name: glyoxalase domain containing 4
  ENST ID: ENST00000575790
  CDS Start-End: 37-216
gtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggtatgataccttgtttcttaaaatctcctttaggctctgactacacccggataacagaagacagtttctcaaagccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccct

SEQ ID NO: 138243 - DNA, 447 bp, Homo sapiens
  Payload ID: 7075
  Gene Symbol: GLOD4
  Gene Name: glyoxalase domain containing 4
  ENST ID: ENST00000573137
  CDS Start-End: 1-347
ggtgtaatctactgggaatgaaaatttatgaaaaagatgaagaaaagcaaagggctttgctgggctatgctgataaccagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccg

SEQ ID NO: 138244 - DNA, 1314 bp, Homo sapiens
  Payload ID: 7075
  Gene Symbol: GLOD4
  Gene Name: glyoxalase domain containing 4
  ENST ID: ENST00000574554
  CDS Start-End: 13-243
gcggcgggaatcatggctgctcgcagagctctgcacttcgtattcaaagtgggaaaccgcttccagacggcgcgtttctatcgggacgtcctggggatgaaggccctgcgcggtgttcagcttcaggagcgtggcgagttgccgttggggatcataggccttggagaagggcctaacacgattagtccccgcggtgtgcccacgcacgtcctttcatttaagccactcgtaaacgtttattgagccccgcccttgtggagcttaccgtctaccggaaaagacggttctgcggcatgaggaatttgaagaaggctgcaaagctgcctgtaatgggtatgataccttgtttcttaaaatctcctttaggctctgactacacccggataacagaagacagtttctcaaagccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaa

SEQ ID NO: 138245 - DNA, 677 bp, Homo sapiens
  Payload ID: 7075
  Gene Symbol: GLOD4
  Gene Name: glyoxalase domain containing 4
  ENST ID: ENST00000574581
  CDS Start-End: 1-159
atggctgctcgcagagctctgcacttcgtattcaaagtgggaaaccgcttccagacggcgcgtttctatcgggacgtcctggggatgaaggtggagtcttgctctgtcgccaggctggagtgcagtggcgcgatctcggctcactgttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgccccc

SEQ ID NO: 138246 - DNA, 585 bp, Homo sapiens
  Payload ID: 7075
  Gene Symbol: GLOD4
  Gene Name: glyoxalase domain containing 4
  ENST ID: ENST00000575528
  CDS Start-End: 1-176
ttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagaggactgacgagggccgtgtcctgagtagtgtgtgacccctggctcacgttgcctctgttttcctcaagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaa

SEQ ID NO: 138247 - DNA, 705 bp, Homo sapiens
  Payload ID: 7075
  Gene Symbol: GLOD4
  Gene Name: glyoxalase domain containing 4
  ENST ID: ENST00000576419
  CDS Start-End: 25-705
tgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagaggcaatggcagcagataaaagtgacgagtggtttgccaaacacaataaaccc

SEQ ID NO: 138248 - DNA, 1063 bp, Homo sapiens
  Payload ID: 7075
  Gene Symbol: GLOD4
  Gene Name: glyoxalase domain containing 4
  ENST ID: ENST00000575851
  CDS Start-End: 26-136
gtgacggctgcgtgcggcgggaatcatggctgctcgcagagctctgcacttcgtattcaaagtgggaaaccgcttccagacggcgcgtttctatcgggacgtcctggggatgaagtctgtgctaaagacgctgtgagcagtactagcaacacttcacaatttattctaaatctcacaccaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaat

SEQ ID NO: 138249 - DNA, 428 bp, Homo sapiens
  Payload ID: 7075
  Gene Symbol: GLOD4
  Gene Name: glyoxalase domain containing 4
  ENST ID: ENST00000572220
  CDS Start-End: 22-132
cggctgcgtgcggcgggaatcatggctgctcgcagagctctgcacttcgtattcaaagtgggaaaccgcttccagacggcgcgtttctatcgggacgtcctggggatgaaggctctgactacacccggataacagaagacagtttctcaaagccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtatta

SEQ ID NO: 138250 - DNA, 562 bp, Homo sapiens
  Payload ID: 7075
  Gene Symbol: GLOD4
  Gene Name: glyoxalase domain containing 4
  ENST ID: ENST00000576670
  CDS Start-End: 1-205
tttctatcgggacgtcctggggatgaaggtgcaggccggggccgacaggggctggcgcgcgaggctggaaccggcgcccgagccggccctggcggagggaggggaaaatgggtgtgtcgtgaacctaagccggagggtgtccgaccttaggccctgcgcggtgttcagcttcaggagcgtggcgagttgccgttggggatcataggccttggagaagggcctaacacgattagtccccgcggtgtgcccacgcacgtcctttcatttaagccactcgtaaacgtttattgagccccgcccttgtggagcttaccgtctaccggaaaagacggttctgcggcatgaggaatttgaagaaggctgcaaagctgcctgtaatgggtatgataccttgtttcttaaaatctcctttaggctctgactacacccggataacagaagacagtttctcaaagccttatgatgggaaatggagtaaaacaatggtgggatttgggcctgaggatgatcattttgtcgcagaactgacttacaattatggcgtcggagactacaagcttgg

SEQ ID NO: 138251 - DNA, 111 bp, Homo sapiens
  Payload ID: 7075
  Gene Symbol: GLOD4
  Gene Name: glyoxalase domain containing 4
  ENST ID: ENST00000628529
  CDS Start-End: 1-111
atggctgctcgcagagctctgcacttcgtattcaaagtgggaaaccgcttccagacggcgcgtttctatcgggacgtcctggggatgaaggctctgactacacccggataa

SEQ ID NO: 138252 - DNA, 111 bp, Homo sapiens
  Payload ID: 7075
  Gene Symbol: GLOD4
  Gene Name: glyoxalase domain containing 4
  ENST ID: ENST00000625892
  CDS Start-End: 1-111
atggctgctcgcagagctctgcacttcgtattcaaagtgggaaaccgcttccagacggcgcgtttctatcgggacgtcctggggatgaagtctgtgctaaagacgctgtga

SEQ ID NO: 138253 - DNA, 735 bp, Homo sapiens
  Payload ID: 7076
  Gene Symbol: GLOD5
  Gene Name: glyoxalase domain containing 5
  Uniprot ID: A6NK44
  ENST ID: ENST00000303227
  CDS Start-End: 42-524
ggattgtcgggaggaccctgggcaaagacgcctaccctgccatgctgcgccatctgccctccaggctgccagtcaagatgtggggcaggactttggagaaacagtcatggagggacagcagtcagacccctcccccatgtcttatccgtagacttgaccacatcgtgatgacggtgaagagcatcaaagacaccaccatgttttattccaagatcctgggcatggaggtcatgacttttaaggaagaccggaaagcactgtgttttggagaccagaaatttaacctccacgaggtgggaaaggaatttgaacccaaagccgctcacccagttcctggctccctggacatatgtctgatcacagaggtgcctttggaggaaatgatccagcacctcaaggcttgtgatgtccctattgaggaggggccagtccccagaacaggggcaaaagggcctatcatgtccatctacttccgagaccccgacagaaatctgattgaggtgtccaactacatctcctcgtgatggaggctggacctcctccattctgtcccccttgatgtcgccctctcctttccttcctgcaaacccccacccaggcccagagatctccaaagactgaggacttaggcacttcacacatcctgctgaggggggacccaagacaggtttgggaccaaacctacatgtctgtatgtcatcaaagttggcctaataaatgcataacctctcaatg

SEQ ID NO: 138254 - DNA, 594 bp, Homo sapiens
  Payload ID: 7076
  Gene Symbol: GLOD5
  Gene Name: glyoxalase domain containing 5
  ENST ID: ENST00000445229
  CDS Start-End: 1-383
ttatccgtagacttgaccacatcgtgatgacggtgaagagcatcaaagacaccaccatgttttattccaagatcctgggcatggaggtcatgacttttaaggaagaccggaaagcactgtgttttggagaccagaaatttaacctccacgaggtgggaaaggaatttgaacccaaagccgctcacccagttcctggctccctggacatatgtctgatcacagaggtgcctttggaggaaatgatccagcacctcaaggcttgtgatgtccctattgaggaggggccagtccccagaacaggggcaaaagggcctatcatgtccatctacttccgagaccccgacagaaatctgattgaggtgtccaactacatctcctcgtgatggaggctggacctcctccattctgtcccccttgatgtcgccctctcctttccttcctgcaaacccccacccaggcccagagatctccaaagactgaggacttaggcacttcacacatcctgctgaggggggacccaagacaggtttgggaccaaacctacatgtctgtatgtcatcaaagttggcctaataaatgcataacctctcaatg

SEQ ID NO: 138255 - DNA, 2012 bp, Homo sapiens
  Payload ID: 7077
  Gene Symbol: GLO1
  Gene Name: glyoxalase I
  Uniprot ID: Q04760
  ENST ID: ENST00000373365
  CDS Start-End: 88-642
ctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataagactatgtttaatttgtaaa

SEQ ID NO: 138256 - DNA, 3772 bp, Homo sapiens
  Payload ID: 7078
  Gene Symbol: GLYR1
  Gene Name: glyoxylate reductase 1 homolog (Arabidopsis)
  Uniprot ID: Q49A26
  ENST ID: ENST00000321919
  CDS Start-End: 78-1739
ggcccactccaatgggcggcgccggggcgacttgctgttcccggcggcccgtgcgtcggcggtggttgggtggtaagatggcggctgtgagtctgcggctcggcgacttggtgtgggggaaactcggccgatatcctccttggccaggaaagattgttaatccaccaaaggacttgaagaaacctcgcggaaagaaatgcttctttgtgaaattttttggaacagaagatcatgcctggatcaaagtggaacagctgaagccatatcatgctcataaagaggaaatgataaaaattaacaagggtaaacgattccagcaagcggtagatgctgtcgaagagttcctcaggagagccaaagggaaagaccagacgtcatcccacaattcttctgatgacaagaatcgacgtaattccagtgaggagagaagtaggccaaactcaggtgatgagaagcgcaaacttagcctgtctgaagggaaggtgaagaagaacatgggagaaggaaagaagagggtgtcttcaggctcttcagagagaggctccaaatcccctctgaaaagagcccaagagcaaagtccccggaagcggggtcggcccccaaaggatgagaaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaagccagctgtctgttaccaggcaatcacgaagaagttgaaaatatgtgaagaggaaactggctccacctccatccaggcagctgacagcacagccgtgaatggcagcatcacacccacagacaaaaagataggatttttgggccttggtctcatgggaagtggaatcgtctccaacttgctaaaaatgggtcacacagtgactgtctggaaccgcactgcagagaaatgtgatttgttcatccaggagggggcccgtctgggaagaacccccgctgaagtcgtctcaacctgcgacatcactttcgcctgcgtgtcggatcccaaggcggccaaggacctggtgctgggccccagtggtgtgctgcaagggatccgccctgggaagtgctacgtggacatgtcaacagtggacgctgacaccgtcactgagctggcccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtgaagtgggcaatgcagccaagatgatgctgatcgtgaacatggtccaagggagcttcatggccactattgccgaggggctgaccctggcccaggtgacaggccagtcccagcagacactcttggacatcctcaatcagggacagttggccagcatcttcctggaccagaagtgccaaaatatcctgcaaggaaactttaagcctgatttctacctgaaatacattcagaaggatctccgcttagccattgcgctgggtgatgcggtcaaccatccgactcccatggcagctgcagcaaatgaggtgtacaaaagagccaaggcgctggaccagtctgacaacgatatgtccgccgtgtaccgagcctacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactggattccctacaaggagaggccttgggcccagatgagccagtacagactccagacagaggggcccttggggccctccaacctcaggtgatgagctgagaaagatgttcacgtctaagcgtccagtgtgcacccagcgctccatagacgcctttgtgaactgaaaagagactggcagagtcccgagaagatggggccctggctttccagggagtgcagcaagcagccggcctgcaggtgagcatggaggcccggccctcaccgcctcgaagccatgccccagatgccactgccacagcgggcgctcgctcctccctaggctgttttagtatttggatttgcattccatcccttgggagggagtcctcagggccactagtgatgagccaagaggagtgggggttgggggcgctcctttctgtttccgttaggccacagactcttcacctggctctgaagagccactcttacctcggtcccctcccagtggtcccaccttctccaccctgccctgccaagtcccctgcatgcccaccgctctccatcctccctcctctccctcttcctcccgtggagacagtatttctttctgtctgtccctttggcccagacccagcctgaccaacgatgagcatttcttaggctcagctcttgatacggaaacgagtgtcttcactccagccagcatcatggtcttcggtgcttcccgggcccggggtctgtcgggagggaagagaactgggcctgacctacctgaactgactggccctccgaggtgggtctgggacatcctagaggccctacatttgtccttggataggggaccggggggggcttggaatgttgcaaaaaaaaaagttacccaagggatgtcagttttttatccctctgcatgggttggattttccaaaatcataatttgcagaaggaaggccagcatttacgatgcaatatgtaattatatatagggtggccacactagggcggggtccttcccccctcacagctttggcccctttcagagattagaaactgggttagaggattgcagaagacgagtggggggagggcagggaagatgcctgtcgggtttttagcacagttcatttcactgggattttgaagcatttctgtctgaacacaaagcctgttctagtcctggcggaacacactgggggtgggggcgggggaagatgcggtaatgaaaccggttagtcaattttgtcttaatattgttgacaattctgtaaagttcctttttatgaatatttctgtttaagctatttcacctttcttttgaaatccttcccttttaaggagaaaatgtgacacttgtgaaaaagcttgtaagaaagcccctcccttttttctttaaacctttaaatgacaaatctaggtaattaaggttgtgaatttttatttttgctttgtttttaatgaacatttgtctttcagaataggattgtgtgataatgtttaaatggcaaaaacaaaacatgattttgtgcaattaacaaagctactgcaagaaaaataaaacacttcttggtaacaca

SEQ ID NO: 138257 - DNA, 3466 bp, Homo sapiens
  Payload ID: 7078
  Gene Symbol: GLYR1
  Gene Name: glyoxylate reductase 1 homolog (Arabidopsis)
  Uniprot ID: Q49A26
  ENST ID: ENST00000436648
  CDS Start-End: 15-1433
ggttgggtggtaagatggcggctgtgagtctgcggctcggcgacttggtgtgggggaaactcggccgatatcctccttggccaggaaagattgttaatccaccaaaggacttgaagaaacctcgcggaaagaaatgcttctttgtgaaattttttggaacagaagatcatgcctggatcaaagtggaacagctgaagccatatcatgctcataaagaggaaatgataaaaattaacaagggtaaacgattccagcaagcggtagatgctgtcgaagagttcctcaggagagccaaagggaaagaccaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaagccagctgtctgttaccaggcaatcacgaagaagttgaaaatatgtgaagaggaaactggctccacctccatccaggcagctgacagcacagccgtgaatggcagcatcacacccacagacaaaaagataggatttttgggccttggtctcatgggaagtggaatcgtctccaacttgctaaaaatgggtcacacagtgactgtctggaaccgcactgcagagaaatgtgatttgttcatccaggagggggcccgtctgggaagaacccccgctgaagtcgtctcaacctgcgacatcactttcgcctgcgtgtcggatcccaaggcggccaaggacctggtgctgggccccagtggtgtgctgcaagggatccgccctgggaagtgctacgtggacatgtcaacagtggacgctgacaccgtcactgagctggcccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtgaagtgggcaatgcagccaagatgatgctgatcgtgaacatggtccaagggagcttcatggccactattgccgaggggctgaccctggcccaggtgacaggccagtcccagcagacactcttggacatcctcaatcagggacagttggccagcatcttcctggaccagaagtgccaaaatatcctgcaaggaaactttaagcctgatttctacctgaaatacattcagaaggatctccgcttagccattgcgctgggtgatgcggtcaaccatccgactcccatggcagctgcagcaaatgaggtgtacaaaagagccaaggcgctggaccagtctgacaacgatatgtccgccgtgtaccgagcctacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactggattccctacaaggagaggccttgggcccagatgagccagtacagactccagacagaggggcccttggggccctccaacctcaggtgatgagctgagaaagatgttcacgtctaagcgtccagtgtgcacccagcgctccatagacgcctttgtgaactgaaaagagactggcagagtcccgagaagatggggccctggctttccagggagtgcagcaagcagccggcctgcaggtgagcatggaggcccggccctcaccgcctcgaagccatgccccagatgccactgccacagcgggcgctcgctcctccctaggctgttttagtatttggatttgcattccatcccttgggagggagtcctcagggccactagtgatgagccaagaggagtgggggttgggggcgctcctttctgtttccgttaggccacagactcttcacctggctctgaagagccactcttacctcggtcccctcccagtggtcccaccttctccaccctgccctgccaagtcccctgcatgcccaccgctctccatcctccctcctctccctcttcctcccgtggagacagtatttctttctgtctgtccctttggcccagacccagcctgaccaacgatgagcatttcttaggctcagctcttgatacggaaacgagtgtcttcactccagccagcatcatggtcttcggtgcttcccgggcccggggtctgtcgggagggaagagaactgggcctgacctacctgaactgactggccctccgaggtgggtctgggacatcctagaggccctacatttgtccttggataggggaccggggggggcttggaatgttgcaaaaaaaaaagttacccaagggatgtcagttttttatccctctgcatgggttggattttccaaaatcataatttgcagaaggaaggccagcatttacgatgcaatatgtaattatatatagggtggccacactagggcggggtccttcccccctcacagctttggcccctttcagagattagaaactgggttagaggattgcagaagacgagtggggggagggcagggaagatgcctgtcgggtttttagcacagttcatttcactgggattttgaagcatttctgtctgaacacaaagcctgttctagtcctggcggaacacactgggggtgggggcgggggaagatgcggtaatgaaaccggttagtcaattttgtcttaatattgttgacaattctgtaaagttcctttttatgaatatttctgtttaagctatttcacctttcttttgaaatccttcccttttaaggagaaaatgtgacacttgtgaaaaagcttgtaagaaagcccctcccttttttctttaaacctttaaatgacaaatctaggtaattaaggttgtgaatttttatttttgctttgtttttaatgaacatttgtctttcagaataggattgtgtgataatgtttaaatggcaaaaacaaaacatgattttgtgcaattaacaaagctactgcaagaaaaataaaacacttcttggtaacaca

SEQ ID NO: 138258 - DNA, 897 bp, Homo sapiens
  Payload ID: 7078
  Gene Symbol: GLYR1
  Gene Name: glyoxylate reductase 1 homolog (Arabidopsis)
  ENST ID: ENST00000587936
  CDS Start-End: 1-114
gagggggcccgtctgggaagaacccccgctgaagtcgtctcaacctgcgacatcactttcgcctgcgtgtcggatcccaaggcggccaaggacctgatagaaatcaggaaatgagccaaaacagcagcaggattctgatctgaggtctgtagggctcctgagcatctgcccgggagcctgggctattgcttctcccttgtgtccccacagctggtgctgggccccagtggtgtgctgcaagggatccgccctgggaagtgctacgtggacatgtcaacagtggacgctgacaccgtcactgagctggcccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtaacacgcctgcacctgtcaggcctggagcctggggccacatctcctctgtttcacactgatgacagcgtcagtcccacacggcctttctgccggggaccctggggaagatgcggtaatgaaaccggttagtcaattttgtcttaatattgttgacaattctgtaaagttcctttttatgaatatttctgtttaagctatttcacctttcttttgaaatccttcccttttaaggagaaaatgtgacacttgtgaaaaagcttgtaagaaagcccctcccttttttctttaaacctttaaatgacaaatctaggtaattaaggttgtgaatttttatttttgctttgtttttaatgaacatttgtctttcagaataggattgtgtgataatgtttaaatggcaaaaacaaaacatgattttg

SEQ ID NO: 138259 - DNA, 3527 bp, Homo sapiens
  Payload ID: 7078
  Gene Symbol: GLYR1
  Gene Name: glyoxylate reductase 1 homolog (Arabidopsis)
  ENST ID: ENST00000588732
  CDS Start-End: 7-165
ggtaagatggcggctgtgagtctgcggctcggcgacttggtgtgggggaaactcggccgatatcctccttggccaggaaagattgttaatccaccaaaggacttgaagaaacctcgcggaaagaaatgcttctttgtgaaattttttggaacagaagatcaatagacccagccccatttctctatcacaagccagcttagcagcctgtggtggcagtatttcaaggagatcgctggcctggagctgtggagccagagcttctggaagagggaatgttcttagaactccatggatttaaaaagaagatttggccgggcatggtgcctcaggcctgcaatcccagtactttgggaggccaagtgcctggatcaaagtggaacagctgaagccatatcatgctcataaagaggaaatgataaaaattaacaagggtaaacgattccagcaagcggtagatgctgtcgaagagttcctcaggagagccaaagggaaagaccagacgtcatcccacaattcttctgatgacaagaatcgacgtaattccagtgaggagagaagtaggccaaactcaggtgatgagaagcgcaaacttagcctgtctgaagggaaggtgaagaagaacatgggagaaggaaagaagagggtgtcttcaggctcttcagagagaggctccaaatcccctctgaaaagagcccaagagcaaagtccccggaagcggggtcggcccccaaaggatgagaaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaagccagctgtctgttaccaggcaatcacgaagaagttgaaaatatgtgaagaggaaactggctccacctccatccaggcagctgacagcacagccgtgaatggcagcatcacacccacagacaaaaagataggatttttgggccttggtctcatgggaagtggaatcgtctccaacttgctaaaaatgggtcacacagtgactgtctggaaccgcactgcagagaaatgtgatttgttcatccaggagggggcccgtctgggaagaacccccgctgaagtcgtctcaacctgcgacatcactttcgcctgcgtgtcggatcccaaggcggccaaggacctggtgctgggccccagtggtgtgctgcaagggatccgccctgggaagtgctacgtggacatgtcaacagtggacgctgacaccgtcactgagctggcccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtgaagtgggcaatgcagccaagatgatgctgatcgtgaacatggtccaagggagcttcatggccactattgccgaggggctgaccctggcccaggtgacaggccagtcccagcagacactcttggacatcctcaatcagggacagttggccagcatcttcctggaccagaagtgccaaaatatcctgcaaggaaactttaagcctgatttctacctgaaatacattcagaaggatctccgcttagccattgcgctgggtgatgcggtcaaccatccgactcccatggcagctgcagcaaatgaggtgtacaaaagagccaaggcgctggaccagtctgacaacgatatgtccgccgtgtaccgagcctacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactggattccctacaaggagaggccttgggcccagatgagccagtacagactccagacagaggggcccttggggccctccaacctcaggtgatgagctgagaaagatgttcacgtctaagcgtccagtgtgcacccagcgctccatagacgcctttgtgaactgaaaagagactggcagagtcccgagaagatggggccctggctttccagggagtgcagcaagcagccggcctgcagacccagcctgaccaacgatgagcatttcttaggctcagctcttgatacggaaacgagtgtcttcactccagccagcatcatggtcttcggtgcttcccgggcccggggtctgtcgggagggaagagaactgggcctgacctacctgaactgactggccctccgaggtgggtctgggacatcctagaggccctacatttgtccttggataggggaccggggggggcttggaatgttgcaaaaaaaaaagttacccaagggatgtcagttttttatccctctgcatgggttggattttccaaaatcataatttgcagaaggaaggccagcatttacgatgcaatatgtaattatatatagggtggccacactagggcggggtccttcccccctcacagctttggcccctttcagagattagaaactgggttagaggattgcagaagacgagtggggggagggcagggaagatgcctgtcgggtttttagcacagttcatttcactgggattttgaagcatttctgtctgaacacaaagcctgttctagtcctggcggaacacactgggggtgggggcgggggaagatgcggtaatgaaaccggttagtcaattttgtcttaatattgttgacaattctgtaaagttcctttttatgaatatttctgtttaagctatttcacctttcttttgaaatccttcccttttaaggagaaaatgtgacacttgtgaaaaagcttgtaagaaagcccctcccttttttctttaaacctttaaatgacaaatctaggtaattaaggttgtgaatttttatttttgctttgtttttaatgaacatttgtctttcagaataggattgtgtgataatgtttaaatggcaaaaacaaaacatgattttgtgcaattaacaaagctactgcaagaaaaataaaacacttcttggtaacaca

SEQ ID NO: 138260 - DNA, 3606 bp, Homo sapiens
  Payload ID: 7078
  Gene Symbol: GLYR1
  Gene Name: glyoxylate reductase 1 homolog (Arabidopsis)
  ENST ID: ENST00000589389
  CDS Start-End: 1-1573
ggggaaactcggccgatatcctccttggccaggaaagattgttaatccaccaaaggacttgaagaaacctcgcggaaagaaatgcttctttgtgaaattttttggaacagaagatcatgcctggatcaaagtggaacagctgaagccatatcatgctcataaagaggaaatgataaaaattaacaagggtaaacgattccagcaagcggtagatgctgtcgaagagttcctcaggagagccaaagggaaagaccagacgtcatcccacaattcttctgatgacaagaatcgacgtaattccagtgaggagagaagtaggccaaactcaggtgatgagaagcgcaaacttagcctgtctgaagggaaggtgaagaagaacatgggagaaggaaagaagagggtgtcttcaggctcttcagagagaggctccaaatcccctctgaaaagagcccaagagcaaagtccccggaagcggggtcggcccccaaaggatgagaaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaaggaaactggctccacctccatccaggcagctgacagcacagccgtgaatggcagcatcacacccacagacaaaaagataggatttttgggccttggtctcatgggaagtggaatcgtctccaacttgctaaaaatgggtcacacagtgactgtctggaaccgcactgcagagaaatgtgatttgttcatccaggagggggcccgtctgggaagaacccccgctgaagtcgtctcaacctgcgacatcactttcgcctgcgtgtcggatcccaaggcggccaaggacctggtgctgggccccagtggtgtgctgcaagggatccgccctgggaagtgctacgtggacatgtcaacagtggacgctgacaccgtcactgagctggcccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtgaagtgggcaatgcagccaagatgatgctgatcgtgaacatggtccaagggagcttcatggccactattgccgaggggctgaccctggcccaggtgacaggccagtcccagcagacactcttggacatcctcaatcagggacagttggccagcatcttcctggaccagaagtgccaaaatatcctgcaaggaaactttaagcctgatttctacctgaaatacattcagaaggatctccgcttagccattgcgctgggtgatgcggtcaaccatccgactcccatggcagctgcagcaaatgaggtgtacaaaagagccaaggcgctggaccagtctgacaacgatatgtccgccgtgtaccgagcctacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactggattccctacaaggagaggccttgggcccagatgagccagtacagactccagacagaggggcccttggggccctccaacctcaggtgatgagctgagaaagatgttcacgtctaagcgtccagtgtgcacccagcgctccatagacgcctttgtgaactgaaaagagactggcagagtcccgagaagatggggccctggctttccagggagtgcagcaagcagccggcctgcaggtgagcatggaggcccggccctcaccgcctcgaagccatgccccagatgccactgccacagcgggcgctcgctcctccctaggctgttttagtatttggatttgcattccatcccttgggagggagtcctcagggccactagtgatgagccaagaggagtgggggttgggggcgctcctttctgtttccgttaggccacagactcttcacctggctctgaagagccactcttacctcggtcccctcccagtggtcccaccttctccaccctgccctgccaagtcccctgcatgcccaccgctctccatcctccctcctctccctcttcctcccgtggagacagtatttctttctgtctgtccctttggcccagacccagcctgaccaacgatgagcatttcttaggctcagctcttgatacggaaacgagtgtcttcactccagccagcatcatggtcttcggtgcttcccgggcccggggtctgtcgggagggaagagaactgggcctgacctacctgaactgactggccctccgaggtgggtctgggacatcctagaggccctacatttgtccttggataggggaccggggggggcttggaatgttgcaaaaaaaaaagttacccaagggatgtcagttttttatccctctgcatgggttggattttccaaaatcataatttgcagaaggaaggccagcatttacgatgcaatatgtaattatatatagggtggccacactagggcggggtccttcccccctcacagctttggcccctttcagagattagaaactgggttagaggattgcagaagacgagtggggggagggcagggaagatgcctgtcgggtttttagcacagttcatttcactgggattttgaagcatttctgtctgaacacaaagcctgttctagtcctggcggaacacactgggggtgggggcgggggaagatgcggtaatgaaaccggttagtcaattttgtcttaatattgttgacaattctgtaaagttcctttttatgaatatttctgtttaagctatttcacctttcttttgaaatccttcccttttaaggagaaaatgtgacacttgtgaaaaagcttgtaagaaagcccctcccttttttctttaaacctttaaatgacaaatctaggtaattaaggttgtgaatttttatttttgctttgtttttaatgaacatttgtctttcagaataggattgtgtgataatgtttaaatggcaaaaacaaaacatgattttgtgcaattaacaaagctactgcaagaaaaataaaacacttcttggtaacaca

SEQ ID NO: 138261 - DNA, 688 bp, Homo sapiens
  Payload ID: 7078
  Gene Symbol: GLYR1
  Gene Name: glyoxylate reductase 1 homolog (Arabidopsis)
  ENST ID: ENST00000587297
  CDS Start-End: 1-516
acgtcatcccacaattcttctgatgacaagaatcgacgtaattccagtgaggagagaagtaggccaaactcaggtgatgagaagcgcaaacttagcctgtctgaagggaaggtgaagaagaacatgggagaaggaaagaagagggtgtcttcaggctcttcagagagaggctccaaatcccctctgaaaagagcccaagagcaaagtccccggaagcggggtcggcccccaaaggatgagaaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaagccagctgtctgttaccaggcaatcacgaagaagttgaaaatatgtgaagaggaaactggctccacctccatccaggcagctgacagcacagccgtgaatggcagcatcacacccacagacaaaaagtaggacctttgatgaaaaggcctccagtggctctggttctgctgagggtggggagaaggtgaccccaggggggttctttaagggttgtgtcccagccattgctggcattgaatggaaaaggtggggggatgttgtaactcttatcgataaagacaggagtcaaaagctgtgtaaa

SEQ ID NO: 138262 - DNA, 580 bp, Homo sapiens
  Payload ID: 7078
  Gene Symbol: GLYR1
  Gene Name: glyoxylate reductase 1 homolog (Arabidopsis)
  ENST ID: ENST00000588297
  CDS Start-End: 24-580
gtcggcggtggttgggtggtaagatggcggctgtgagtctgcggctcggcgacttggtgtgggggaaactcggccgatatcctccttggccaggaaagattgttaatccaccaaaggacttgaagaaacctcgcggaaagaaatgcttctttgtgaaattttttggaacagaagatcatgcctggatcaaagtggaacagctgaagccatatcatgctcataaagaggaaatgataaaaattaacaagggtaaacgattccagcaagcggtagatgctgtcgaagagttcctcaggagagccaaagggaaagaccaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaaggaaactggctccacctccatccaggcagctgacagcacagccgtgaatggcagcatcacacccacagacaaaaagataggatttttgggccttggtctcatgggaagtggaatcgtctc

SEQ ID NO: 138263 - DNA, 1831 bp, Homo sapiens
  Payload ID: 7078
  Gene Symbol: GLYR1
  Gene Name: glyoxylate reductase 1 homolog (Arabidopsis)
  Uniprot ID: Q49A26
  ENST ID: ENST00000591451
  CDS Start-End: 1-1644
atggcggctgtgagtctgcggctcggcgacttggtgtgggggaaactcggccgatatcctccttggccaggaaagattgttaatccaccaaaggacttgaagaaacctcgcggaaagaaatgcttctttgtgaaattttttggaacagaagatcatgcctggatcaaagtggaacagctgaagccatatcatgctcataaagaggaaatgataaaaattaacaagggtaaacgattccagcaagcggtagatgctgtcgaagagttcctcaggagagccaaagggaaagaccagacgtcatcccacaattcttctgatgacaagaatcgacgtaattccagtgaggagagaagtaggccaaactcaggtgatgagaagcgcaaacttagcctgtctgaagggaaggtgaagaagaacatgggagaaggaaagaagagggtgtcttcaggctcttcagagagaggctccaaatcccctctgaaaagagcccaagagcaaagtccccggaagcggggtcggcccccaaaggatgagaaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaagccagctgtctgttaccaggcaatcacgaagaagttgaaaatatgtgaagaggaaactggctccacctccatccaggcagctgacagcacagccgtgaatggcagcatcacacccacagacaaaaagataggatttttgggccttggtctcatgggaagtggaatcgtctccaacttgctaaaaatgggtcacacagtgactgtctggaaccgcactgcagagaaagagggggcccgtctgggaagaacccccgctgaagtcgtctcaacctgcgacatcactttcgcctgcgtgtcggatcccaaggcggccaaggacctggtgctgggccccagtggtgtgctgcaagggatccgccctgggaagtgctacgtggacatgtcaacagtggacgctgacaccgtcactgagctggcccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtgaagtgggcaatgcagccaagatgatgctgatcgtgaacatggtccaagggagcttcatggccactattgccgaggggctgaccctggcccaggtgacaggccagtcccagcagacactcttggacatcctcaatcagggacagttggccagcatcttcctggaccagaagtgccaaaatatcctgcaaggaaactttaagcctgatttctacctgaaatacattcagaaggatctccgcttagccattgcgctgggtgatgcggtcaaccatccgactcccatggcagctgcagcaaatgaggtgtacaaaagagccaaggcgctggaccagtctgacaacgatatgtccgccgtgtaccgagcctacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggagggg

SEQ ID NO: 138264 - DNA, 1280 bp, Homo sapiens
  Payload ID: 7079
  Gene Symbol: GRHPR
  Gene Name: glyoxylate reductase/hydroxypyruvate reductase
  Uniprot ID: Q9UBQ7
  ENST ID: ENST00000318158
  CDS Start-End: 86-1072
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcagaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgaga

SEQ ID NO: 138265 - DNA, 1593 bp, Homo sapiens
  Payload ID: 7079
  Gene Symbol: GRHPR
  Gene Name: glyoxylate reductase/hydroxypyruvate reductase
  Uniprot ID: Q9UBQ7
  ENST ID: ENST00000494290
  CDS Start-End: 674-1432
ttctgcagatgaggcagagacacttttcttccagtggcccttatttggagaagcctggcagaagggcgtgagcctagccaagcagctatctattggtggttctctgtcatcctgcctggtgcaggggtgcgggtgagggtggagagtgtggagaacctgtctagccaacgaacagccctgcctctcactagagagttgcttggaggaacccaacagctttggggcacgttctgagcctgaaaatccaactgtacaaatctgtctcagcagcagcttacatgaaaattgtaagtttggggtgagctggcagtttggcagtgccaccaaaaagtcaaatggggtctgagactgcattcacagaagcagagggtccaggacaaaggaggggactgcttgaccaggtgtctcccttgtgaaaacctctccagttctcagaggttaggaaaaacctgagtggctttccagatggcttggaccatgtgaggacagcatcagccagtcacagcctcaggggagctgaggtgctgtctccagatccctggggcagtgtgggctggctgggggctagttacagtggggcagccagccccccacccgctttggaggagacaggagcaggcaactcgggctgtgctgatgaaaagggtctgccctgagggccgctgttccagaaatgctgggtggtgtccctaccctttgcgggactgggaacgagacatggactctccttgctctaggccaggccattgctcggcgtctgaaaccattcggtgtccagagatttctgtacacagggcgccagcccaggcctgaggaagcagcagaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggtatcctagggccaccttacccagcaagcctggagaggagccatccccactgctgccatctggagattttcttccccgtgggttgttggtgagaccccaggctgagcttgctggtttccataaaccaaacaaccaactcagaaattcgtgggaatacacgagacctccgtacagggaagaagagccgtcagagtgggcctggcctgtctgcttctcagcagtggcccccacccggcggggcctggcacacagcagcgtggcttcagggagtgttcccagggagcctctgcaggcccattatcctccaccacaaagggctggacttgaggatctgaagggccctctggaggccgcctcccacactgctgagcctggctttgtctggctgtggttcagtgatactttgaaccttatgctcctgggcggacagaccctaaaactcacgtggtcgtagctcctcacactgtccctaggggtgccttcaggccactgggcatgtatggaggtgtgattctctgaggaaagagtgattctgatatatgtacttgtcacattggtgttggacacatttgcgccaaaagtatggtaattctattattaaataattctctgaga

SEQ ID NO: 138266 - DNA, 1704 bp, Homo sapiens
  Payload ID: 7079
  Gene Symbol: GRHPR
  Gene Name: glyoxylate reductase/hydroxypyruvate reductase
  ENST ID: ENST00000607784
  CDS Start-End: 6-1082
tgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcagaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtggtcctggaattcagctcacggcctggggactgcttcaaaaggcaggtcttggtctgaggagagggcagtcagggcatgaagctgcagccgccaccgctgcttctacaaaatctaagcactgggctgcagccatgtcctactgccagcaggaagggaaggatgcaatcatttgtgatgtaaaaagaccatgcagctccaagcaacacagctgatgaccccagtgatccctatggggggagcacggattgaggctgccaaatggagacattaactggaactgcctgtgccttgggggaagggccagcggcccctgtggggaacaattcaagctggacttttcctgcttccactatagtatggagaatgtcaaggggtcagactgtgtagaccaattggggccatgcaggaatgcatgcagaaatacccagatctttgtccccaagaaggtgaggcagaggtagaggaaaagcccgcagaacatgtagaagtagcagctcccactgaggccactgcaaccaaagaggaggaggggtcaagttaatgaaggccataggactccagtccttccaccccttcagagtgacacggaccttttgcaaaatgccatttagtcaccctccaacaaagtgtctttccctctgttgtcctgtaaactgtaatgtacgaaataacatattttgatgatcggggtcttggcctcttgacatatacgctaaaaaaatgggggttgttttatatgtgtcctgtgtaaacctgtcggcaaatatagccaccacttttgaattctcctagatggccctgaattttgccactttgaaataatgtgctactcaa

SEQ ID NO: 138267 - DNA, 3713 bp, Homo sapiens
  Payload ID: 7080
  Gene Symbol: GPC1
  Gene Name: glypican 1
  Uniprot ID: P35052
  ENST ID: ENST00000264039
  CDS Start-End: 249-1925
gggactgcgctagcccgccgcgctctgggctgcccgagcgagcgttcggacctcgcaccccgcgcgccccgcgccgccgccgccgccggcttttgttgtctccgcctcctcggccgccgccgcctctggaccgcgagccgcgcgcgccgggaccttggctctgcccttcgcgggcgggaactgcgcaggacccggccaggatccgagagaggcgcgggcgggtggccgggggcgccgccggccccgccatggagctccgggcccgaggctggtggctgctatgtgcggccgcagcgctggtcgcctgcgcccgcggggacccggccagcaagagccggagctgcggcgaggtccgccagatctacggagccaagggcttcagcctgagcgacgtgccccaggcggagatctcgggtgagcacctgcggatctgtccccagggctacacctgctgcaccagcgagatggaggagaacctggccaaccgcagccatgccgagctggagaccgcgctccgggacagcagccgcgtcctgcaggccatgcttgccacccagctgcgcagcttcgatgaccacttccagcacctgctgaacgactcggagcggacgctgcaggccaccttccccggcgccttcggagagctgtacacgcagaacgcgagggccttccgggacctgtactcagagctgcgcctgtactaccgcggtgccaacctgcacctggaggagacgctggccgagttctgggcccgcctgctcgagcgcctcttcaagcagctgcacccccagctgctgctgcctgatgactacctggactgcctgggcaagcaggccgaggcgctgcggcccttcggggaggccccgagagagctgcgcctgcgggccacccgtgccttcgtggctgctcgctcctttgtgcagggcctgggcgtggccagcgacgtggtccggaaagtggctcaggtccccctgggcccggagtgctcgagagctgtcatgaagctggtctactgtgctcactgcctgggagtccccggcgccaggccctgccctgactattgccgaaatgtgctcaagggctgccttgccaaccaggccgacctggacgccgagtggaggaacctcctggactccatggtgctcatcaccgacaagttctggggtacatcgggtgtggagagtgtcatcggcagcgtgcacacgtggctggcggaggccatcaacgccctccaggacaacagggacacgctcacggccaaggtcatccagggctgcgggaaccccaaggtcaacccccagggccccgggcctgaggagaagcggcgccggggcaagctggccccgcgggagaggccaccttcaggcacgctggagaagctggtctccgaagccaaggcccagctccgcgacgtccaggacttctggatcagcctcccagggacactgtgcagtgagaagatggccctgagcactgccagtgatgaccgctgctggaacgggatggccagaggccggtacctccccgaggtcatgggtgacggcctggccaaccagatcaacaaccccgaggtggaggtggacatcaccaagccggacatgaccatccggcagcagatcatgcagctgaagatcatgaccaaccggctgcgcagcgcctacaacggcaacgacgtggacttccaggacgccagtgacgacggcagcggctcgggcagcggtgatggctgtctggatgacctctgcagccggaaggtcagcaggaagagctccagctcccggacgcccttgacccatgccctcccaggcctgtcagagcaggaaggacagaagacctcggctgccagctgcccccagcccccgaccttcctcctgcccctcctcctcttcctggcccttacagtagccaggccccggtggcggtaactgccccaaggccccagggacagaggccaaggactgactttgccaaaaatacaacacagacgatatttaattcacctcagcctggagaggcctggggtgggacagggagggccggcggctctgagcaggggcaggcgcagaggtcccagccccaggcctggcctcgcctgcctttctgccttttaattttgtatgaggtcctcaggtcagctgggagccagtgtgcccaaaagccatgtatttcagggacctcaggggcacctccggctgcctagccctccccccagctccctgcaccgccgcagaagcagcccctcgaggcctacagaggaggcctcaaagcaacccgctggagcccacagcgagcctgtgccttcctccccgcctcctcccactgggactcccagcagagcccaccagccagccctggcccaccccccagcctccagagaagccccgcacgggctgtctgggtgtccgccatccagggtctggcagagcctctgagatgatgcatgatgccctcccctcagcgcaggctgcagagcccggccccacctccctgcgcccttgaggggccccagcgtctgcagggtgacgcctgagacagcaccactgctgaggagtctgaggactgtcctcccacagacctgcagtgaggggccctccatgcgcagatgaggggccactgacccacctgcgcttctgctggaggaggggaagctgggcccaaaggcccagggaggcagcgtgggctctgccaatgtgggctgcccctcgcacacagggctcacagggcaggccttgctggggtccagggctgttggaggaccccgagggctgaggagcagccaggacccgcctgctcccatcctcacccagatcaggaaccagggcctccctgttcacggtgacacaggtcagggctcagagtgaccctcagctgtcacctgctcacagggatgctggtggctggtgagaccccgcactgcagacgggaatgcctaggtcccttcccgacccagccagctgcagggcacggggacctggatagttaagggcttttccaaacatgcatccatttactgacacttcctgtccttgttcatggagagctgttcgctcctcccagatggcttcggagggccgcagggcccaccttggaccctggtgacctcctgtcactcactgaggccatcagggccctgccccaggcctggacgggccctccttccctcctgtgccccagctgccaggcggccctggggaggggtggtgtggtgttgggaaggggtcctgcagggggaggaggacttggagggtctgggggcagctgtcctgaaccgactgaccctgaggaggccgcttagtgctgctttgcttttcatcaccgtcccgcacagtggacggaggtccccggttgctggtcaggtccccatggcttgttctctggaacctgactttagatgttttgggatcaggagcccccaacacaggcaagtccaccccataataaccctgccagtgccagggtgggctggggactctggcacagtgatgccgggcgccaggacagcagcactcccgctgcacacagacggcctaggggtggcgctcagaccccaccctacgctcatctctggaaggggcagccctgagtggtcactggtcagggcagtggccaagcctgctgtgtccttcctccacaaggtccccccaccgctcagtgtcagcgggtgacgtgtgttcttttgagtccttgtatgaataaaaggctggaaacctaca

SEQ ID NO: 138268 - DNA, 573 bp, Homo sapiens
  Payload ID: 7080
  Gene Symbol: GPC1
  Gene Name: glypican 1
  ENST ID: ENST00000427506
  CDS Start-End: 87-573
agcaaactcagtctgacccaggcattcaacctctgggtgagcacctgcggatctgtccccagggctacacctgctgcaccagcgagatggaggagaacctggccaaccgcagccatgccgagctggagaccgcgctccgggacagcagccgcgtcctgcaggccatgcttgccacccagctgcgcagcttcgatgaccacttccagcacctgctgaacgactcggagcggacgctgcaggccaccttccccggcgccttcggagagctgtacacgcagaacgcgagggccttccgggacctgtactcagagctgcgcctgtactaccgcggtgccaacctgcacctggaggagacgctggccgagttctgggcccgcctgctcgagcgcctcttcaagcagctgcacccccagctgctgctgcctgatgactacctggactgcctgggcaagcaggccgaggcgctgcggcccttcggggaggccccgagagagctgcgcctgcgggccacccgtgccttcgtggctgctcgctcctttgtgcagggcctgggcgtggccagcgacgtggtcc

SEQ ID NO: 138269 - DNA, 841 bp, Homo sapiens
  Payload ID: 7080
  Gene Symbol: GPC1
  Gene Name: glypican 1
  ENST ID: ENST00000455111
  CDS Start-End: 1-841
tgctcactgcctgggagtccccggcgccaggccctgccctgactattgccgaaatgtgctcaagggctgccttgccaaccaggccgacctggacgccgagtggaggaacctcctggactccatggtgctcatcaccgacaagttctggggtacatcgggtgtggagagtgtcatcggcagcgtgcacacgtggctggcggaggccatcaacgccctccaggacaacagggacacgctcacggccaaggaccctgcagtgtctctccaggtcatccagggctgcgggaaccccaaggtcaacccccagggccccgggcctgaggagaagcggcgccggggcaagctggccccgcgggagaggccaccttcaggcacgctggagaagctggtctccgaagccaaggcccagctccgcgacgtccaggacttctggatcagcctcccagggacactgtgcagtgagaagatggccctgagcactgccagtgatgaccgctgctggaacgggatggccagaggccggtacctccccgaggtcatgggtgacggcctggccaaccagatcaacaaccccgaggtggaggtggacatcaccaagccggacatgaccatccggcagcagatcatgcagctgaagatcatgaccaaccggctgcgcagcgcctacaacggcaacgacgtggacttccaggacgccagtgacgacggcagcggctcgggcagcggtgatggctgtctggatgacctctgcagccggaaggtcagcaggaagagctccagctcccggacgcccttgacccatgccctcccaggcctgtcagagcaggaaggacagaagacc

SEQ ID NO: 138270 - DNA, 1085 bp, Homo sapiens
  Payload ID: 7080
  Gene Symbol: GPC1
  Gene Name: glypican 1
  ENST ID: ENST00000425056
  CDS Start-End: 204-1085
ctgtgcctgacctaggccagcaccaggagggccttagaggcgggggacgaggcccagaaggaacagtgtggccccgtcagtgtggagtcctgagcttaggcagccggaaccacttgccccctcactgtatagctgggacgagacctcatccctgtgagcacctgcggatctgtccccagggctacacctgctgcaccagcgagatggaggagaacctggccaaccgcagccatgccgagctggagaccgcgctccgggacagcagccgcgtcctgcaggccatgcttgccacccagctgcgcagcttcgatgaccacttccagcacctgctgaacgactcggagcggacgctgcaggccaccttccccggcgccttcggagagctgtacacgcagaacgcgagggccttccgggacctgtactcagagctgcgcctgtactaccgcggtgccaacctgcacctggaggagacgctggccgagttctgggcccgcctgctcgagcgcctcttcaagcagctgcacccccagctgctgctgcctgatgactacctggactgcctgggcaagcaggccgaggcgctgcggcccttcggggaggccccgagagagctgcgcctgcgggccacccgtgccttcgtggctgctcgctcctttgtgcagggcctgggcgtggccagcgacgtggtccggaaagtggctcaggtccccctgggcccggagtgctcgagagctgtcatgaagctggtctactgtgctcactgcctgggagtccccggcgccaggccctgccctgactattgccgaaatgtgctcaagggctgccttgccaaccaggccgacctggacgccgagtggaggaacctcctggactccatggtgctcatcaccgacaagttctggggtacatcgggtgtggagagtgtcatcggcagcgtgcacacgtggctggcggaggccatcaacgccctccaggacaacagggacacgctcacggccaaggtcatccagggctgcgggaaccccaaggtcaacccccagggccccgggcctgaggagaagcggcgccggggcaagctggccccg

SEQ ID NO: 138271 - DNA, 636 bp, Homo sapiens
  Payload ID: 7080
  Gene Symbol: GPC1
  Gene Name: glypican 1
  ENST ID: ENST00000426280
  CDS Start-End: 168-636
actggtcacgggcagctgccaggctgggtctggacaaatgaggtctgggtccatcattggggatgggggccactgtcaggatgggagtctcgcctaaagctttggggtgaaggtgctgatgaccaagaggaaactgcggggtggggacatgtcagcaggggacgagaatgcatgacctaaaaggtgagcacctgcggatctgtccccagggctacacctgctgcaccagcgagatggaggagaacctggccaaccgcagccatgccgagctggagaccgcgctccgggacagcagccgcgtcctgcaggccatgcttgccacccagctgcgcagcttcgatgaccacttccagcacctgctgaacgactcggagcggacgctgcaggccaccttccccggcgccttcggagagctgtacacgcagaacgcgagggccttccgggacctgtactcagagctgcgcctgtactaccgcggtgccaacctgcacctggaggagacgctggccgagttctgggcccgcctgctcgagcgcctcttcaagcagctgcacccccagctgctgctgcctgatgactacctggactgcctgggcaagcaggccgaggcgctgcggcccttcggggaggccccga

SEQ ID NO: 138272 - DNA, 1835 bp, Homo sapiens
  Payload ID: 7080
  Gene Symbol: GPC1
  Gene Name: glypican 1
  ENST ID: ENST00000420138
  CDS Start-End: 335-1795
cgcgccagtgcggctgcggcgctgcccggggtggctgcggccagagtctcccgcgcgcccggcggaccgcagcccgccctcgtcccccgctggcttttcgcctcctgcgagcccttccgcccggccccgctccgccgcctttccccggcccgagcacctgcacccagagcccgcgcgccgcccggagccgctggagccgccgctgcgaagggggtcccgcgtccgccgccgcgctggaagccaggcccgaggacctctcccgcagcgccaccgtacccgcatccgtgagcacctgcggatctgtccccagggctacacctgctgcaccagcgagatggaggagaacctggccaaccgcagccatgccgagctggagaccgcgctccgggacagcagccgcgtcctgcaggccatgcttgccacccagctgcgcagcttcgatgaccacttccagcacctgctgaacgactcggagcggacgctgcaggccaccttccccggcgccttcggagagctgtacacgcagaacgcgagggccttccgggacctgtactcagagctgcgcctgtactaccgcggtgccaacctgcacctggaggagacgctggccgagttctgggcccgcctgctcgagcgcctcttcaagcagctgcacccccagctgctgctgcctgatgactacctggactgcctgggcaagcaggccgaggcgctgcggcccttcggggaggccccgagagagctgcgcctgcgggccacccgtgccttcgtggctgctcgctcctttgtgcagggcctgggcgtggccagcgacgtggtccggaaagtggctcaggtccccctgggcccggagtgctcgagagctgtcatgaagctggtctactgtgctcactgcctgggagtccccggcgccaggccctgccctgactattgccgaaatgtgctcaagggctgccttgccaaccaggccgacctggacgccgagtggaggaacctcctggactccatggtgctcatcaccgacaagttctggggtacatcgggtgtggagagtgtcatcggcagcgtgcacacgtggctggcggaggccatcaacgccctccaggacaacagggacacgctcacggccaaggtcatccagggctgcgggaaccccaaggtcaacccccagggccccgggcctgaggagaagcggcgccggggcaagctggccccgcgggagaggccaccttcaggcacgctggagaagctggtctccgaagccaaggcccagctccgcgacgtccaggacttctggatcagcctcccagggacactgtgcagtgagaagatggccctgagcactgccagtgatgaccgctgctggaacgggatggccagaggccggtacctccccgaggtcatgggtgacggcctggccaaccagatcaacaaccccgaggtggaggtggacatcaccaagccggacatgaccatccggcagcagatcatgcagctgaagatcatgaccaaccggctgcgcagcgcctacaacggcaacgacgtggacttccaggacgccagtgacgacggcagcggctcgggcagcggtgatggctgtctggatgacctctgcagccggaaggtcagcaggaagagctccagctcccggacgcccttgacccatgccctcccaggcctgtcagagcaggaaggacagaagacctcggctgccagctgcccccagcccccgaccttcctcctgcccctcctcctcttcctggcccttacagtagccaggccccggtggcggtaactgccccaaggccccagggacagaggccaaggactgactt

SEQ ID NO: 138273 - DNA, 2532 bp, Homo sapiens
  Payload ID: 7081
  Gene Symbol: GPC2
  Gene Name: glypican 2
  Uniprot ID: Q8N158
  ENST ID: ENST00000292377
  CDS Start-End: 169-1908
ggcagatgccgcctggtccagctatcgtgctcggtattcagttttccggagcagcgctctttctctggcccgcggagcggtcccgcggccgagtaccggattcccgagtttgggaggctctgctttcctccttaggacccactttgccgtcctggggtggctgcagttatgtccgcgctgcgacctctcctgcttctgctgctgcctctgtgtcccggtcctggtcccggacccgggagcgaggcaaaggtcacccggagttgtgcagagacccggcaggtgctgggggcccggggatatagcttaaacctaatccctcccgccctgatctcaggtgagcacctccgggtctgtccccaggagtacacctgctgttccagtgagacagagcagaggctgatcagggagactgaggccaccttccgaggcctggtggaggacagcggctcctttctggttcacacactggctgccaggcacagaaaatttgatgagttttttctggagatgctctcagtagcccagcactctctgacccagctcttctcccactcctacggccgcctgtatgcccagcacgccctcatattcaatggcctgttctctcggctgcgagacttctatggggaatctggtgaggggttggatgacaccctggcggatttctgggcacagctcctggagagagtgttcccgctgctgcacccacagtacagcttcccccctgactacctgctctgcctctcacgcttggcctcatctaccgatggctctctgcagccctttggggactcaccccgccgcctccgcctgcagataacccggaccctggtggctgcccgagcctttgtgcagggcctggagactggaagaaatgtggtcagcgaagcgcttaaggtgccggtgtctgaaggctgcagccaggctctgatgcgtctcatcggctgtcccctgtgccggggggtcccctcacttatgccctgccagggcttctgcctcaacgtggttcgtggctgtctcagcagcaggggactggagcctgactggggcaactatctggatggtctcctgatcctggctgataagctccagggccccttttcctttgagctgacggccgagtccattggggtgaagatctcggagggtttgatgtacctgcaggaaaacagtgcgaaggtgtccgcccaggtgtttcaggagtgcggcccccccgacccggtgcctgcccgcaaccgtcgagccccgccgccccgggaagaggcgggccggctgtggtcgatggtgaccgaggaggagcggcccacgacggccgcaggcaccaacctgcaccggctggtgtgggagctccgcgagcgtctggcccggatgcggggcttctgggcccggctgtccctgacggtgtgcggagactctcgcatggcagcggacgcctcgctggaggcggcgccctgctggaccggagccgggcggggccggtacttgccgccagtggtcgggggctccccggccgagcaggtcaacaaccccgagctcaaggtggacgcctcgggccccgatgtcccgacacggcggcgtcggctacagctccgggcggccacggccagaatgaaaacggccgcactgggacacgacctggacgggcaggacgcggatgaggatgccagcggctctggagggggacagcagtatgcagatgactggatggctggggctgtggctcccccagcccggcctcctcggcctccataccctcctagaagggatggttctgggggcaaaggaggaggtggcagtgcccgctacaaccagggccggagcaggagtgggggggcatctattggttttcacacccaaaccatcctcattctctccctctcagccctggccctgcttggacctcgataacgggggaggggtgccctagcatcagaagggttcatggccctttcccctcctcccccctcagctgggcctggggaggagtcgaagggggctgcagagagggtagagaagggactttgcaggtgaatggctggggccccaaatccaggagattttcatcagaggtgggtgggtgttcacaatatttattttttcatttggtaatgggaggggggcctgggggtatttatttaggagggagtgtggtttccttagaaggtatagtctctagccctctaaggctggggctggtgatcagccccaacagagaaaatgaggagtttagagttgcagctggggaaggggtttgaaggaagttggaagtggggaggggtgggggcatctggtctcagaaatggaccagctggatgcagggcaggggactgagggtgcttgagtaggatgtgagacttcatgggcctgggttctgttgagttttttcagtatcaatttcttaaaccaaattttaaaaaaaacaaggtgggggggtgctcatctcgtgacctctgccacccacatccttcacaaactccatgtttcagtgtttgagtccatgtttattctgcaaataaatggtaatgtattgga

SEQ ID NO: 138274 - DNA, 767 bp, Homo sapiens
  Payload ID: 7081
  Gene Symbol: GPC2
  Gene Name: glypican 2
  ENST ID: ENST00000480087
  CDS Start-End: 171-575
tcggcagatgccgcctggtccagctatcgtgctcggtattcagttttccggagcagcgctctttctctggcccgcggagcggtcccgcggccgagtaccggattcccgagtttgggaggctctgctttcctccttaggacccactttgccgtcctggggtggctgcagttatgtccgcgctgcgacctctcctgcttctgctgctgcctctgtgtcccggtcctggtcccggacccgggagcgaggcaaaggtcacccggagttgtgcagagacccggcaggtgctgggggcccggggatatagcttaaacctaatccctcccgccctgatctcaggtgagcacctccgggtctgtccccaggagtacacctgctgttccagtgagacagagcagaggctgatcagggagactgaggccaccttccgaggcctggtggaggacagcggctcctttctggttcacacactggctgccaggcacagaaaatttgatgataacccggaccctggtggctgcccgagcctttgtgcagggcctggagactggaagaaatgtggtcagcgaagcgcttaaggtgccggtgtctgaaggctgcagccaggctctgatgcgtctcatcggctgtcccctgtgccggggggtcccctcacttatgccctgccagggcttctgcctcaacgtggttcgtggctgtctcagcagcaggggactggagcctgactggggcaactatctggatggtctcctgatcctggctgataagct

SEQ ID NO: 138275 - DNA, 2568 bp, Homo sapiens
  Payload ID: 7082
  Gene Symbol: GPC3
  Gene Name: glypican 3
  Uniprot ID: P51654
  ENST ID: ENST00000370818
  CDS Start-End: 447-2189
cgccctgtgtagagcggctgcgagcgggcagctgggctcggctgccgggagccaccgcgcgggctccgcaccctcctctcgcactgccttcgcccggtccccgcgccgcggtgccccagtggcccccgccgcgctccacgccgcgcccccgcaccccgccggctaccggccgcacaaccgccaccgccccctggccgcgcggctcgcctcgccccgccccgtccctcctcgccccgccccaccccagtcagccccgccctgccccgcgccgccaagcggttcccgccctcgcccagcgcccaggtagctgcgaggaaacttttgcagcggctgggtagcagcacgtctcttgctcctcagggccactgccaggcttgccgagtcctgggactgctctcgctccggctgccactctcccgcgctctcctagctccctgcgaagcaggatggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctatttttttttttttgttatcctgtatacctcctccagccatgaagtagaggactaaccatgtgttatgttttcgaaaatcaaatggtatcttttggaggaagatacattttagtggtagcatatagattgtccttttgcaaagaaagaaaaaaaaccatcaagttgtgccaaattattctcctatgtttggctgctagaacatggttaccatgtctttctctctcactccctccctttctatcgttctctctttgcatggatttctttgaaaaaaaataaattgctcaaataaaaa

SEQ ID NO: 138276 - DNA, 2379 bp, Homo sapiens
  Payload ID: 7082
  Gene Symbol: GPC3
  Gene Name: glypican 3
  Uniprot ID: P51654
  ENST ID: ENST00000394299
  CDS Start-End: 198-2009
agccccgccctgccccgcgccgccaagcggttcccgccctcgcccagcgcccaggtagctgcgaggaaacttttgcagcggctgggtagcagcacgtctcttgctcctcagggccactgccaggcttgccgagtcctgggactgctctcgctccggctgccactctcccgcgctctcctagctccctgcgaagcaggatggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactgaaactgagaagaaaatatggcacttcaaatatcctatcttcttcctgtgtatagggctagacttacagattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctatttttttttttttgttatcctgtatacctcctccagccatgaagtagaggactaaccatgtgttatgttttcgaaaatcaaatggtatcttttggaggaagatacattttagtggtagcatatagattgtccttttgcaaagaaagaaaaaaaaccatcaagttgtgccaaattattctcctatgtttggctgctagaacatggttaccatgtctttctctctcactccctccctttctatcgttctctctttgcatggatttctttgaaaaaaaataaattgctc

SEQ ID NO: 138277 - DNA, 836 bp, Homo sapiens
  Payload ID: 7082
  Gene Symbol: GPC3
  Gene Name: glypican 3
  ENST ID: ENST00000406757
  CDS Start-End: 1-770
ttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcaggtaactgattagtgctgacccaaatgtaatctaaaaatggtgatgctcaggaattaaaaataaattgaacccgc

SEQ ID NO: 138278 - DNA, 1581 bp, Homo sapiens
  Payload ID: 7082
  Gene Symbol: GPC3
  Gene Name: glypican 3
  Uniprot ID: P51654
  ENST ID: ENST00000631057
  CDS Start-End: 1-1581
atggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactga

SEQ ID NO: 138279 - DNA, 4960 bp, Homo sapiens
  Payload ID: 7083
  Gene Symbol: GPC4
  Gene Name: glypican 4
  Uniprot ID: O75487
  ENST ID: ENST00000370828
  CDS Start-End: 526-2196
cagtcaatcagcggcagagctgagaagggcacagccgcgcggcggagggcagagtcagccgagccgagtccagccggacgagcggaccagcgcagggcagcccaagcagcgcgcagcgaacgcccgccgccgcccacaccctctgcggtccccgcggcgcctgccacccttccctccttccccgcgtccccgcctcgccggccagtcagcttgccgggttcgctgccccgcgaaaccccgaggtcaccagcccgcgcctctgcttccctgggccgcgcgccgcctccacgccctccttctcccctggcccggcgcctggcaccggggaccgttgcctgacgcgaggcccagctctacttttcgccccgcgtctcctccgcctgctcgcctcttccaccaactccaactccttctccctccagctccactcgctagtccccgactccgccagccctcggcccgctgccgtagcgccgcttcccgtccggtcccaaaggtgggaacgcgtccgccccggcccgcaccatggcacggttcggcttgcccgcgcttctctgcaccctggcagtgctcagcgccgcgctgctggctgccgagctcaagtcgaaaagttgctcggaagtgcgacgtctttacgtgtccaaaggcttcaacaagaacgatgcccccctccacgagatcaacggtgatcatttgaagatctgtccccagggttctacctgctgctctcaagagatggaggagaagtacagcctgcaaagtaaagatgatttcaaaagtgtggtcagcgaacagtgcaatcatttgcaagctgtctttgcttcacgttacaagaagtttgatgaattcttcaaagaactacttgaaaatgcagagaaatccctgaatgatatgtttgtgaagacatatggccatttatacatgcaaaattctgagctatttaaagatctcttcgtagagttgaaacgttactacgtggtgggaaatgtgaacctggaagaaatgctaaatgacttctgggctcgcctcctggagcggatgttccgcctggtgaactcccagtaccactttacagatgagtatctggaatgtgtgagcaagtatacggagcagctgaagcccttcggagatgtccctcgcaaattgaagctccaggttactcgtgcttttgtagcagcccgtactttcgctcaaggcttagcggttgcgggagatgtcgtgagcaaggtctccgtggtaaaccccacagcccagtgtacccatgccctgttgaagatgatctactgctcccactgccggggtctcgtgactgtgaagccatgttacaactactgctcaaacatcatgagaggctgtttggccaaccaaggggatctcgattttgaatggaacaatttcatagatgctatgctgatggtggcagagaggctagagggtcctttcaacattgaatcggtcatggatcccatcgatgtgaagatttctgatgctattatgaacatgcaggataatagtgttcaagtgtctcagaaggttttccagggatgtggaccccccaagcccctcccagctggacgaatttctcgttccatctctgaaagtgccttcagtgctcgcttcagaccacatcaccccgaggaacgcccaaccacagcagctggcactagtttggaccgactggttactgatgtcaaggagaaactgaaacaggccaagaaattctggtcctcccttccgagcaacgtttgcaacgatgagaggatggctgcaggaaacggcaatgaggatgactgttggaatgggaaaggcaaaagcaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgactttgttttctcattcagttttgggaggaaaagggactgtgcattgagttggttcctgctcccccaaaccatgttaaacgtggctaacagtgtaggtacagaactatagttagttgtgcatttgtgattttatcactctattatttgtttgtatgtttttttctcatttcgtttgtgggtttttttttccaactgtgatctcgccttgtttcttacaagcaaaccagggtcccttcttggcacgtaacatgtacgtatttctgaaatattaaatagctgtacagaagcaggttttatttatcatgttatcttattaaaagaaaaagcccaaaaagcagtaaaatttccatttctccctgttattttagttgccttatctggagagacgtggaggtgattttcttttttttaaattattattaagacagaatgtgagggcacaagcaggcttctgagccacttgtcagattgtattcaaagcatcaatccaagaaggaggttatgtgtacttcatttattggtgatagttggaagagactgcagactactgctttgaatgagttgaattacataagctaagatcactataggtccatttcttgaacccacttatacataaaatgtaacccatttagaaaaagattctggatatcatcccccttgaaagatagaaagcattcaggatgtcccagttatcacatgttcacacttgggtttaggggtgtttttttttaaaaccaggcaggttagctagcccaccctgtgctagttttcatgttcacactgaccctatttgaattaatatcctttgttagagtggtcgagatttcaaacccaattatgtacagggagctgtctgagagctagccagaactggggtacagcctgggctcagggaatagctgtcaacactcgggcaaagtttttgtctgtgcatgtgtatctccatttgttttgggatcccagtttttgttttaagagagtataaggtgtctcatttgagtctttttcttacctagccccctcttatcagtaaaacaaaggacttgccatggttcacagcaatgtgctacgatccaagatatcagccaaggagcccacttaggggagaactaggtgtccagatttttgtatgtgttgtttttcttgggggatggggtggggtgggagtaggtagagctgagaatactacatcttagtggtgacctttagccacgtgggtgaagtggcaaaggccatggccatatctgttgtcccaggccaaagactaacaactgccttgggaatcccttccttgtgtccttaccaaatgatagctcataaaactctgataatgtaacaaatcactttcaaaggagttcccagaagtcttcagaaagactaaaattctgtctcttcctgctttagacagccattaagatcccaactaattttaccgaacctaaaacccacaaagaggttgtttgtgttattgttcaatcttcagttgtaagagtaattctctatttttatattgaaacataattacttgatagctcagggtctacatttcattcaactttttacaccaaattctgcagagtggtcaaaatggaatattgggggctgttgtaaacagaggcttaattttattagaagtagccagttatttattaaagcatgatgttaataaaataggcatattctggctggtgtgtataagtggttttttttttaaaacaaatcagaagacataaaattgaaaaggcactccatttatatataagggaaaatagattgtaaatagctaaggggccttgtgagaacttggaaaatgtgctgatacttagtaactacctcagttgtgaggaatttcctttttagcttagactgctattacttttacttggtagaaatgaatctggtctccaaaatatggctcagagagttatccccatagaccttgttagattgtttttaatttaaaaccttgaactctgcccagctgttttcttccagtcaaattctctaaaccaataacattttccaaattaagtattcttgaaggttcttctgaactcttactgatttgttttctttctttgcattttttcctgttactcttttattatttaaattgtctcttgcttttgaacttcaactatgaaataaacaaatcatagatttttccattcaggtctgactggataactcttggcttctaagcagctggcaagctcacccccactccccaaaaaagaagaaaggcaagttgaatattttaaaaccttaagagtttggagtatgaagtagaataaaagccttgttaggagaagacctgacttttccaaagttaacagcatgtgaagggcttgtgttttacaaagtcatttataaattatttttctttaaaacacatcacctactctgtaccttaaagattttacaactcttagatttatattttatttcaaaaatcgtaactagcacctgttattttgattaaaagacactgcgaagaattgacgtaaatttctaaagtttagttactgagtgttcaaaacctaacagttcacatgaagtaaaaattgtcatttgtgattacagaatcaaaataaaaataggtatgaatggtgcta

SEQ ID NO: 138280 - DNA, 2957 bp, Homo sapiens
  Payload ID: 7084
  Gene Symbol: GPC5
  Gene Name: glypican 5
  Uniprot ID: P78333
  ENST ID: ENST00000377067
  CDS Start-End: 441-2159
cagcgagcgggcacatcccaggttagctgctgcgagccgagccgggcggcggaggcggcggcggcggcggcagtggcggcagtggcggcagtggcggcagcggcagcagttgcagcagtggtggccagagcggatgcttgcgggctccctgcggctccactagttttcttcgccccgcccagccgcccactcttctcggctagggaagaagaccagagggtgctcagctggaaaactctggtgtctcagcttagggcctcctccgggaagagctaactgctcccaggtgaagccggtgcccgcgggcggtccgtacaccccgcagccggctcgcaccgctcgagagcctcggccgctgtgtcttccacgtctgcagctcagccagggcgcgcagggcgagtggggtccactggcgggtaaaggggaccaggacggcgaggatggacgcacagacctggcccgtgggctttcgctgcctcctccttctggccctggttgggtccgcccgcagcgagggcgtgcagacctgcgaagaagttcggaaacttttccagtggcggctgctgggagctgtcagggggctgccggattcgccgcgggcaggacctgatcttcaggtttgcatatccaaaaagcctacatgttgcaccaggaagatggaggagagatatcagattgcggctcgccaggatatgcagcagtttcttcaaacgtccagctctacattaaagtttctaatatctcgaaatgcggctgcttttcaagaaacccttgaaactctcatcaaacaagcagaaaattacaccagtatacttttttgcagtacctacaggaacatggccttggaggctgctgcttcggttcaggagttcttcactgatgtggggctgtatttatttggtgcggatgttaatcctgaagaatttgtaaacagattttttgacagtctttttcctctggtctacaaccacctcattaaccctggtgtgactgacagttccctggaatactcagaatgcatccggatggctcgccgggatgtgagtccatttggtaatattccccaaagagtaatgggacagatggggaggtccctgctgcccagccgcacttttctgcaggcactcaatctgggcattgaagtcatcaacaccacagactatctgcacttctccaaagagtgcagcagagccctcctgaagatgcaatactgcccgcactgccaaggcctggcgctcactaagccttgtatgggatactgcctcaatgtcatgcgaggctgcctggcgcacatggcggagcttaatccacactggcatgcatatatccggtcgttggaagaactctcggatgcaatgcatggaacatacgacattggacacgtgctgctgaactttcacttgcttgttaatgatgctgtgttacaggctcacctcaatggacaaaaattattggaacaggtaaataggatttgtggccgccctgtaagaacacccacacaaagcccccgttgttcttttgatcagagcaaagagaagcatggaatgaagaccaccacaaggaacagtgaagagacgcttgccaacagaagaaaagaatttatcaacagccttcgactgtacaggtcattctatggaggtctagctgatcagctttgtgctaatgaattagctgctgcagatggacttccctgctggaatggagaagatatagtaaaaagttatactcagcgtgtggttggaaatggaatcaaagcccagtctggaaatcctgaagtcaaagtcaaaggaattgatcctgtgataaatcagattattgataaactgaagcatgttgttcagttgttacagggtagatcacccaaacctgacaagtgggaacttcttcagctgggcagtggtggaggcatggttgaacaagtcagtggggactgtgatgatgaagatggttgcgggggatcaggaagtggagaagtcaagaggacactgaagatcacagactggatgccagatgatatgaacttcagtgatgtaaagcaaatccatcaaacagacactggcagtactttagacacaacaggagcaggatgtgcagtggcgactgaatctatgacattcactctgataagtgtggtgatgttacttcccgggatttggtaactgaactcttctgtcctgacataccttactgaagtctcgatttcttctctctctgcatatgcctggaataagagatcctttttcaatgtaacaattatatttatgaaaagatatgttacactaacttctcagaagccaagctgaaatattcataaagtccctaaaactcaacgtttaaatgacacactttaaaaatatgtcttttttcaatctaactgaaaaccttcttaacttctaatatattaaatctgaagatgtgaagggcacagaagtgactttgaataagaagaatttagtgtatctgtaattttattatcaattccaagccccttcctttctaaattaaaaatgttttcatttgaaagtgtatttgccagacaatgaaaacagtatgcagtatttcttaaagtattgaaattagaatatcatgaaataaatcaaaacatacaatggcaagtagtatgcatgcatattcaagagactcttccatttttgcaagctgtagaaggaaatgtctgaatgtctataagttatggggtagattcttgagaagcatttcatataatttcactgaagaaccttgataattttgacccactgtaacttagccactgatgaaccttaaagctgagtattttattaacacctgatttgtattccattatattcaaaatgcatctttggtattgtgcctctgctcccatctctctctttgcctcatagatttagctatgttgggaagcacatgcttgctctaggaatatctccaataaagctgttaactatttggtggaaaaa

SEQ ID NO: 138281 - DNA, 610 bp, Homo sapiens
  Payload ID: 7084
  Gene Symbol: GPC5
  Gene Name: glypican 5
  ENST ID: ENST00000618283
  CDS Start-End: 1-155
ggatgccagatgatatgaacttcagtgatgtaaagcaaatccatcaaacagacactggcagtactttagacacaacaggagcaggatgtgcagtggcgactgaatctatgacattcactctgataagtgtggtgatgttacttcccgggatttgaacaagctgacagagcataggagcatgttatctgggcctctgtattgcaggagctcgctcagaaaaatgaagaaagacgagaaaatgctctgtcattcagcaagaaagcagatggaagcttagaatcacagcttatttaaaaggacagcttataaatatgatgtgtttataattttactatttcattttcctcatttataaaaaaattaaagaaaatctcatgagaatttcatcacagatggttaactgcaataaatttatattgaataatttgatttacttctattttgactacacatctattatagtatgggtgtgattgaatgcaaatccacagacacatgtacacatttatctatatctatccataaaatatacatattcatgtttattgttgctatgattgtattgatgcttatatttatatttgtataaaatttgcctttatgtcagtta

SEQ ID NO: 138282 - DNA, 960 bp, Homo sapiens
  Payload ID: 7084
  Gene Symbol: GPC5
  Gene Name: glypican 5
  ENST ID: ENST00000618596
  CDS Start-End: 1-960
gaaacccttgaaactctcatcaaacaagcagaaaattacaccagtatacttttttgcagtacctacaggaacatggccttggaggctgctgcttcggttcaggagttcttcactgatgtggggctgtatttatttggtgcggatgttaatcctgaagaatttgtaaacagattttttgacagtctttttcctctggtctacaaccacctcattaaccctggtgtgactgacagttccctggaatactcagaatgcatccggatggctcgccgggatgtgagtccatttggtaatattccccaaagagtaatgggacagatggggaggtccctgctgcccagccgcacttttctgcaggcactcaatctgggcattgaagtcatcaacaccacagactatctgcacttctccaaagagtgcagcagagccctcctgaagatgcaatactgcccgcactgccaaggcctggcgctcactaagccttgtatgggatactgcctcaatgtcatgcgaggctgcctggcgcacatggcggagcttaatccacactggcatgcatatatccggtcgttggaagaactctcggatgcaatgcatggaacatacgacattggacacgtgctgctgaactttcacttgcttgttaatgatgctgtgttacaggctcacctcaatggacaaaaattattggaacaggtaaataggatttgtggccgccctgtaagaacacccacacaaagcccccgttgttcttttgatcagagcaaagagaagcatggaatgaagaccaccacaaggaacagtgaagagacgcttgccaacagaagaaaagaatttatcaacagccttcgactgtacaggtcattctatggaggtctagctgatcagctttgtgctaatgaattagctgctgcagatggacttccctgctggaatggagaagatatagtaaaaaggtat

SEQ ID NO: 138283 - DNA, 6467 bp, Homo sapiens
  Payload ID: 7085
  Gene Symbol: GPC6
  Gene Name: glypican 6
  Uniprot ID: Q9Y625
  ENST ID: ENST00000377047
  CDS Start-End: 616-2283
ccaggatttctctcttcctatttcaggaggactctcacaggctcccacagcctgtgttaagctgaggtttcccctagatctcgtatatccccaacacatacctccacgcacacacatccccaagaacctcgagctcacaccaacagacacacgcgcgcatacacactcgctctcgcttgtccatctccctcccgggggagccggcgcgcgctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatgccttcttggatcggggctgtgattcttcccctcttggggctgctgctctccctccccgccggggcggatgtgaaggctcggagctgcggagaggtccgccaggcgtacggtgccaagggattcagcctggcggacatcccctaccaggagatcgcaggggaacacttaagaatctgtcctcaggaatatacatgctgcaccacagaaatggaagacaagttaagccaacaaagcaaactcgaatttgaaaaccttgtggaagagacaagccattttgtgcgcaccacttttgtgtccaggcataagaaatttgacgaatttttccgagagctcctggagaatgcagaaaagtcactaaatgatatgtttgtacggacctatggcatgctgtacatgcagaattcagaagtcttccaggacctcttcacagagctgaaaaggtactacactgggggtaatgtgaatctggaggaaatgctcaatgacttttgggctcggctcctggaacggatgtttcagctgataaaccctcagtatcacttcagtgaagactacctggaatgtgtgagcaaatacactgaccagctcaagccatttggagacgtgccccggaaactgaagattcaggttacccgcgccttcattgctgccaggacctttgtccaggggctgactgtgggcagagaagttgcaaaccgagtttccaaggtcagcccaaccccagggtgtatccgtgccctcatgaagatgctgtactgcccatactgtcgggggcttcccactgtgaggccctgcaacaactactgtctcaacgtcatgaagggctgcttggcaaatcaggctgacctcgacacagagtggaatctgtttatagatgcaatgctcttggtggcagagcgactggaggggccattcaacattgagtcggtcatggacccgatagatgtcaagatttctgaagccattatgaacatgcaagaaaacagcatgcaggtgtctgcaaaggtctttcagggatgtggtcagcccaaacctgctccagccctcagatctgcccgctcagctcctgaaaattttaatacacgtttcaggccctacaatcctgaggaaagaccaacaactgctgcaggcacaagcttggaccggctggtcacagacataaaagagaaattgaagctctctaaaaaggtctggtcagcattaccctacactatctgcaaggacgagagcgtgacagcgggcacgtccaacgaggaggaatgctggaacgggcacagcaaagccagatacttgcctgagatcatgaatgatgggctcaccaaccagatcaacaatcccgaggtggatgtggacatcactcggcctgacactttcatcagacagcagattatggctctccgtgtgatgaccaacaaactaaaaaacgcctacaatggcaatgatgtcaatttccaggacacaagtgatgaatccagtggctcagggagtggcagtgggtgcatggatgacgtgtgtcccacggagtttgagtttgtcaccacagaggcccccgcagtggatcccgaccggagagaggtggactcttctgcagcccagcgtggccactccctgctctcctggtctctcacctgcattgtcctggcactgcagagactgtgcagataatcttgggtttttggtcagatgaaactgcattttagctatctgaatggccaactcacttcttttcttacactcttggacaatggaccatgccacaaaaacttaccgttttctatgagaagagagcagtaatgcaatctgcctccctttttgttttcccaaagagtaccgggtgccagactgaactgcttcctctttccttcagctatctgtggggaccttgtttattctagagagaattcttactcaaatttttcgtaccaggagattttcttaccttcatttgcttttatgctgcagaagtaaaggaatctcacgttgtgagggttttttttttctcatttaaaataaaaaaggaagaaagaaaataattttccttgtaaaatcgggccaaaccccaagacagctacattttcaacaaaaaagcaaacagagaaaaataaatgaactttaacactgtaagttcagcattgacagccaacttccagtgtaagcttttttgtgacaaatccgggtttaaaaatgcttatggggagaaagcttaaagtttgttctaaatgtagtgaaaatgcactgttgtcttggaggtatcatcttgcactctaaccaaacaacaccaaattaatctggaggtactgatactaaatttggaatcccgtctttaatatgagaacacaaattactacaactcagtacctctgtcttactctgcccaatttcaatttagtaatggcaccattattcttaattcccttaatgtctgtccgctgtatccaattggcacagattttccccttcatcttcaattactagtagctacccccatcaattcaccttcctcaagagtctcaattgaaaataatctttgatgatacaatctctgcttttgccacaggtttgacattaactagacgtttctgcccctgtgctcattaccctcccaaaacaatagtttttttaatgaattgaaacacaattagatccattcctgagttttcatttttaactatttactttgtgtcagttggtttctgcatcacaagggcattctcttacaaaacaactcacaacagaaaaaaaaagtcaagacaaaaaatatatatatatagtattgacatggagatttctttcacttttttagtcttagtatgatcatctatttttatatctatgtatatataaatcacagattttaacttcttaattccaagctcagggttgacacacctttgtaagaaaatgttttgtcaaccagctcttcttgttttgtgctgctcaaagaagggattcctcagtgatcggtgagcaccaagaatcaagaaagagaactttttatgtatctaactgtccatttattaaaaatttgccagggcacacccttctgcatgagtgtgcttcagcctgggtgctccagactacaccaaactcatgggatgagccattggtgtgcagggctttaccggtgatggaaactgtatgtgtaaagaatgttattcatgaaaaaccattgctttcatgtaaaacaccttcggcctaggattcctgcctggcacttggatacattacctaactcaataggccagtttagagccacagcctaacctgttcaccaagtaggccaaagccaggcctttcgctccccctgacagagagaagcaaaataaacccaactgggggctttatgaatacagttggctatccatatgtttcttagtttttatgatgcatctggagtagggaaaagtaatgtttcaagacaccatagtaggccagttacattttaattaactcatcgacagtattgacacgtaaatggtatttttcaatctgttctcatcaaaattaaaattagttattgatttagtcatcacatttaagtagaacacatgtggcacaatagtattaagtatatttgagcacttttgcaagacagaaagtatttacaagcatctattgctactttatgcctaatgaaatataaaatgtaggatgatgagagactttgtggcattctttcatttaaacctttatgaaattaaccatctagttcatcattacatactcctagaaaaccatccatttcactgcccacattttggcttcctaccacaaattccacataagacttctctatgaaggaccagtcatttacattgctcatttcattctgtgttcagaagtcagtattgtctttctccaataattaaggtgcaatacaaattaaatcaaccttgattttccagactatttgaataataacttgcttttatggctttaaactccaggtctttcctttttaaaatatttctgcattctcttttatgaactagatcaggatgccttgtttttcctgtgctttcacccccaaaaggttttgtgcatgtgtatgaatacacataatattagtgaatgtgaacccatgttctatacgcactaaacacacagttaatatataaacgcctgcttcatttgtttcaacaccttcattatcaatatgattcatattgatgagatatagtgatgcataatgagccaggcagagagctgaaatgatatcagttaatgatgtcacagtgttagcaccctgcatggatgtggtcaaaatatcattcaagttgtacttcctagtttttatcatcatactactatgtcatatgattttcagactaatttaacatgagaaatgttttggccctaaaggatttcacttaacctagttaccctatttcagtaagtattttggaattcaaccctcgaattattttttctcatttcagcatagtgataggggatgcaatgaggcttcattattttttatgacctgcccctcatttgctctgatgttccctaaattctgtaatcatatcataacttttgttatgaatagagaggaatgggctcactgaaacctgacactagaaattggtgggtgatgctcataactgcaaacacttagcttattgaagtgcctctatttacatgttctttagttataatatgtatttttctaacagaaatacacgtctgtaattggtatatattatactttgtatgtgtcacaacaaaagctaaacagaggctaaagtctttagcagagaagaatgaattacaaatttaccaataagagctctgtttatggttctgtattgaaggacaaccatgacaaccttctgtcattttcacgaaggccaagttggtactttgattatagccatcgtagaacattagcactagaaatctgtctcccttacaatgacttacctagctagcatcaagtaacttgtatcacctgctttaaatgtaagggatagaaaatactattttgtctacactgaaaaacattattattcattgataagtagtaataattataaaagtaacattctttaaagcaaacacattgaaaatattattacaggcagaaccctgatttttaatttatattccctgctgcagacattagccttctttaattcttttgccattacatacatgtttcggctacagactgaacacgaactaaagtccctaaggaggaaaaaaccttaacatattcctgagatgtgattcttttattacttctttttgcaaagctaattatcaaatgatttgattaaacctagacgcattaggaaatgcaagttttacctaaaacttgcagaaatttaaacacatttccatttacttactaacgaacagacctgatttttatttaaaaacacaatttagctttgccaacagaagagtaaaggaaaccataacttataaatttgtaatgtgttcctccttgttggagacattagccagtgtttagttttagaccaacttatacaaagagagtattgatttgtacacattctggagacttgctatatcatggtttgctatggcacagactcagcttagcatggggacattttgaacttcattcaaagttgagtagttactggaacctttgacattgccttgtaatgaggtacttccaaaaaaagacccctaacaatggcataatagtgaggtctctctgtgcatatacataatatatatgcaggataaatgtgtgcaccaatcaaatctaaaattttatgtgactgtcaaatgaatattatttgggttaagatttttcatttctgatttggatagaaaattgctattaatcttgtattaaaatagtttttaaaaatcta

SEQ ID NO: 138284 - DNA, 792 bp, Homo sapiens
  Payload ID: 7085
  Gene Symbol: GPC6
  Gene Name: glypican 6
  ENST ID: ENST00000617456
  CDS Start-End: 1-792
gatgcaatgctcttggtggcagagcgactggaggggccattcaacattgagtcggtcatggacccgatagatgtcaagatttctgaagccattatgaacatgcaagaaaacagcatgcaggtgtctgcaaaggtctttcagggatgtggtcagcccaaacctgctccagccctcagatctgcccgctcagctcctgaaaattttaatacacgtttcaggccctacaatcctgaggaaagaccaacaactgctgcaggcacaagcttggaccggctggtcacagacataaaagagaaattgaagctctctaaaaaggtctggtcagcattaccctacactatctgcaaggacgagagcgtgacagcgggcacgtccaacgaggaggaatgctggaacgggcacagcaaagccagatacttgcctgagatcatgaatgatgggctcaccaaccagatcaacaatcccgaggtggatgtggacatcactcggcctgacactttcatcagacagcagattatggctctccgtgtgatgaccaacaaactaaaaaacgcctacaatggcaatgatgtcaatttccaggacacaagtgatgaatccagtggctcagggagtggcagtgggtgcatggatgacgtgtgtcccacggagtttgagtttgtcaccacagaggcccccgcagtggatcccgaccggagagaggtggactcttctgcagcccagcgtggccactccctgctctcctggtctctcacctgcattgtcctggcactgcagagactgtgcagataa

SEQ ID NO: 138285 - DNA, 3896 bp, Homo sapiens
  Payload ID: 7086
  Gene Symbol: GM2A
  Gene Name: GM2 ganglioside activator
  Uniprot ID: P17900
  ENST ID: ENST00000357164
  CDS Start-End: 326-907
gtgctaagctcccttccgttccagccgccttcagccccgccgcgctcagttccgcccctttctcttccaactccgcctacgccccagagagggaaggccttgacacctacgctagagagacaggctccaatgaaaagagcgagggggcggagccgggaggaatcggtccaattctcggccgggaagtctctggccgggacggggcagggcgaacctgccagtgactggactcagcttctttgcgtaaccaatactggaaggcatttaaaggcacctctgccgccacagaccttgcagttaactccgccctgacccacccttcccgatgcagtccctgatgcaggctcccctcctgatcgccctgggcttgcttctcgcggcccctgcgcaagcccacctgaaaaagccatcccagctcagtagcttttcctgggataactgtgatgaagggaaggaccctgcggtgatcagaagcctgactctggagcctgaccccatcatcgttcctggaaatgtgaccctcagtgtcatgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaaggaacctactcactgcccaagagcgaattcgttgtgcctgacctggagctgcccagttggctcaccaccgggaactaccgcatagagagcgtcctgagcagcagtgggaagcgtctgggctgcatcaagatcgctgcctctctaaagggcatataacatggcatctgccacagcagaatggagcggtgtgaggaaggtcccttttcctctgttttgtgtttgccaaggccaaactcccactctctgcccccctttaatcccctttctacagtgagtccactaccctcactgaaaatcattttgtaccacttacattttaggctggggcaagcagccctgacctaagggagaatgagttggacagttcttgatagcccagggcatctgctgggctgaccacgttactcatccccgttaacattctctctaaagagcctcgttcatttccaaagcagttaaggaatgggaaccagagtgttttaggacctgaagaatctttatgactctctctctttcactcttttttttttttgtcactaagttaaaagcgaagtgagagtattaacgtttttgttctcctccggccccctgttacaatgaaggggcaaaagtatttgctcttagtctattcctcccttaacttctgtgactaatttttatttcctttctagatttgcccaattaatactagggtgcagtgtatcctggagaggtagggtgtgtgggggaggaatcccttgggggagatattaggagtgctctgttgtttacaaactcaggtacccgcagggcctagcaagagacttaaatgactgataagaaccgtgagaaacatgttgcttccaggcttgatttcgatttttcgctttttttttttttgagacagaatctcactttgtcaccaggctggagtgcagtggtgcaatctcacctcactgcaacctccgcctcctgggttcaagcaattctcctgcctcagcctcccaagtagcttggactacaggccctgccaccacgcccggctaatttgtgtatttttagtagagatggggtttcaccatgttggccaggatggtctcgatctcttgacctcgtgatctgtccaccttggccttgcaaagcgctggattacaggcatgagccactacacccagccgatttttcctttttgattaaagatgctattacaatgtaaatatttcttacacagaaagtcacagcacatgtgcccattgatacaaggctgctgaggcctggtctccagttggaaatataattaagggtggcaaggactggagtcagttggagagtgcatagccagtctgtgaagacaactgccagatactggcaatactccagcctggtgacagagtgagactctgtctcaaaaaaaaagtttcaatgtttactcctagagaagccaaaaatccagatttgtatatgaaatcttaccattttaaaagattggcagctaattatttttttaaaaagctgtgcagtgtgatgtgtcccaaacggactggctcatgggtggccacgtcacaacctctgatctcagaccgtgcatgccttgtcctcttaagacaactcctgtggcaccgtttctccctccacagggccaaagccatagtgtccggtcccaaggacaaggctcttccagtgctaggagaggtatgagcagcctctcacctgtgagctgtggggatcacaaggctgcctgcctcagtcttggagtcctgttgggtgaatgaggcagatgggaaagagcctcaccagcagctgcttttggagcaggggtccaaggaagagagggtggcctcgacatcaaactgcctggatttttctaccaccctgttacatcataacaacttctgaaacacacaccagccctgagttctgggctcatttgaagcctggaatagcaataaatctttttaacttgcggacagtttccccttgccttggctgcatatttcactgatcacatctcaggatttcaaaagcatttttggggtggggctcttttggttggaagggtttgttggaacggtacaggtgagccgaggtgattccagggacggacccttctgcaggagcttgagcttgcttgttgtctctgcttcatcgccatccagctcccttgtttgctattttgctttccatcacatcatgactgcggagagcaaaaatcacctagtgaccattgaacaggtcccagagacaaaatctttttatctgaggaatttaaaagggagcaaagaccacctggtgactatcaggccatgcagaggcaaaacgccttatttggggaaaattaaaagtaattagactttcctattatctaaagcaggcatctggttccagatttcttttccccgaaaaaaaccttagaagtaactaaaatttctgtacatctccggaatgccatgctgaaactcactgcaaccccacggtcccgctttaaggtccataaatatccctaaggaaaaatccaccgtggtacattcagtcctctcaccgaggtgccccatggcagtcttctgcagcattcttctaatacctttcctttttcaaacctatactgttgttggtgaattctttttaccaacccacgagttgaccacttcccaatgccggggatctgacacctcacctggcaatgacctccacagccgtttccctctgttggatcttccagccttattctcaacagttcatttttagttcacattcttgaccgaatctcagtagctcagttaatctttttatgtctgctctgctcttgggtcatatgttccgtgaggtttcttaggggtgggggatgaggagttaaaggtggcatcttcaatcgcaggtcaaagcagactttaataaatggtgctgagccaactggaaagccccttggagaaagttgaagttagacctgtacttcacaccatatgcaagaatgaactccatctggatccaggatccaaatgtaagaaaatgaagccatataaatacagaaggaaacgtggtggaaatatccagtggcaacaaaatattgacacatttgactacatgaagataataaaaatgcttagtaaaaacacaataaaatcaaatgactgggagaaaaatttatccagcctatataatagacaaa

SEQ ID NO: 138286 - DNA, 553 bp, Homo sapiens
  Payload ID: 7086
  Gene Symbol: GM2A
  Gene Name: GM2 ganglioside activator
  ENST ID: ENST00000523466
  CDS Start-End: 116-553
ggtagcaagaaagctgcagaggaggctgccggcagtacaggatgcagggagaacccaggcctggggttgaggccaggagactcaattccagctttactgtgtgcctttagcaggaatgtcatgggtagaagctgctggcgtgtcatctacagccttggaggacaggattgtggccaagcatgaggaggttccagaagtttcagttcagtatgaagaaaaatttcagaaccatcacaaactgccatcccagctcagtagcttttcctgggataactgtgatgaagggaaggaccctgcggtgatcagaagcctgactctggagcctgaccccatcatcgttcctggaaatgtgaccctcagtgtcatgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacc

SEQ ID NO: 138287 - DNA, 643 bp, Homo sapiens
  Payload ID: 7086
  Gene Symbol: GM2A
  Gene Name: GM2 ganglioside activator
  ENST ID: ENST00000523004
  CDS Start-End: 1-313
gaaggaccctgcggtgatcagaagcctgactctggagcctgaccccatcatcgttcctggaaatgtgaccctcagtgtcatgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaagtaagtacttagggaggagagagcgttacccctgtggctaaagagatggggtttggagagaagggtctttgcattctccttctgcagatctgcatgtctctggatttgtaagccagtgtgacctatcaggaatcacttatcttccgggagcctcagttatccatctacgaaatgggagacttgaacttagatgtgatcttcagggccctttatccataataatccatgctctacagtgctatggccgtctctcatcttgtgcggctgttttgagaatgggaagaggggtggtagttcatggctgcaatcctagcagtggctctaggagaaagaccccatcag

SEQ ID NO: 138288 - DNA, 1866 bp, Homo sapiens
  Payload ID: 7087
  Gene Symbol: GNAS
  Gene Name: GNAS complex locus
  Uniprot ID: P63092
  ENST ID: ENST00000265620
  CDS Start-End: 364-1503
gggcggcggcgggggcccggccgaggcaataagagcggcggcggcggcagcggcggcagcagctcccgcagctcctgctctggtccgcctcggcccggcggcggccatcagccccctcggcctcggctcgaggggcggggagctgcgcgcgcccctcggtccgaccgacaccctccccttcccgcccgtccgcgcgccccgcggcccgcggcccgcagtccgccccgcgcgctccttgccgaggagccgagcccgcgcccggcccgcccgcccggcgctgccccggccctcccggcccgcgtgaggccgcccgcgcccgccgccgccgcagcccggccgcgccccgccgccgccgccgccgccatgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtgctggagaatctggtaaaagcaccattgtgaagcagatgaggatcctgcatgttaatgggtttaatggagatgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaa

SEQ ID NO: 138289 - DNA, 581 bp, Homo sapiens
  Payload ID: 7087
  Gene Symbol: GNAS
  Gene Name: GNAS complex locus
  ENST ID: ENST00000349036
  CDS Start-End: 1-581
cccaaagcctcgcgctctctcaaggtcaagaaggtacccctggcggagaagcgcagacagatgcgcaaagaagccctggagaagcgggcccagaagcgcgcagagaagaaacgcagtaagctcatcgacaaacaactccaggacgaaaagatgggctacatgtgtacgcaccgcctgctgcttctaggtgctggagaatctggtaaaagcaccattgtgaagcagatgaggatcctgcatgttaatgggtttaatggagagggcggcgaagaggacccgcaggctgcaaggagcaacagcgatggcagtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagta

SEQ ID NO: 138290 - DNA, 1878 bp, Homo sapiens
  Payload ID: 7087
  Gene Symbol: GNAS
  Gene Name: GNAS complex locus
  Uniprot ID: P84996
  ENST ID: ENST00000306120
  CDS Start-End: 1-1878
atggcgaggcctgtggacccccagaggtctccagacccaactttcaggtcctcaacccggcattcagggaagctggagcccatggaagctacagcccacctcctgaggaagcaatgcccttcgaggctgaacagcccagcttgggaggcttctggcctacactggagcagcctggattccccagtggggtccatgcaggccttgaggccttcggcccagcactcatggagcccggagccttcagtggtgccagaccaggcctgggaggatacagccctccaccagaagaagctatgccctttgagtttgaccagcctgcccagagaggctgcagtcaacttctcttacaggtcccagaccttgctccaggaggcccaggtgctgcaggggtccccggagctcctcccgaggagccccaagccctcaggcctgcaaaggctggctccagaggaggctacagccctccccctgaggagactatgccatttgagcttgatggagaaggatttggggacgacagcccacccccggggctttcccgagttatcgcacaagtcgacggcagcagccagttcgcggcagtcgcggcctcgagtgcggtccgcctcactcccgccgcgaacgcgcctcccctctgggtcccaggcgccatcggcagcccatcccaagaggctgtcagacctccttctaacttcacgggcagcagcccctggatggagatctccggacccccgttcgagattggcagcgcccccgctggggtcgacgacactcccgtcaacatggacagccccccaatcgcgcttgacggcccgcccatcaaggtctccggagccccagataagagagagcgagcagagagacccccagttgaggaggaagcagcagagatggaaggagccgctgatgccgcggagggaggaaaagtaccctctccggggtacggatcccctgccgccggggcagcctcagcggataccgctgccagggcagcccctgcagccccagccgatcctgactccggggcaaccccagaagatcccgactccgggacagcaccagccgatcctgactccggggcattcgcagccgatcccgactccggggcagcccctgccgccccagccgatcccgactccggggcggcccctgacgccccagccgatcccgactccggggcggcccctgacgccccagccgatccagatgccggggcggcccctgaggctcccgccgcccctgcggctgctgagacccgggcagcccatgtcgccccagctgcgccagacgcaggggctcccactgccccagccgcttctgccacccgggcagcccaagtccgccgggcggcctctgcagcccctgcctccggggccagacgcaagatccatctcagaccccccagccccgagatccaggctgccgatccgcctactccgcggcctactcgcgcgtctgcctggcggggcaagtccgagagcagccgcggccgccgcgtgtactacgatgaaggggtggccagcagcgacgatgactccagcggagacgagtccgacgatgggacctccggatgcctccgctggtttcagcatcggcgaaatcgccgccgccgaaagccccagcgcaacttactccgcaactttctcgtgcaagccttcgggggctgcttcggtcgatctgagagtccccagcccaaagcctcgcgctctctcaaggtcaagaaggtacccctggcggagaagcgcagacagatgcgcaaagaagccctggagaagcgggcccagaagcgcgcagagaagaaacgcagtaagctcatcgacaaacaactccaggacgaaaagatgggctacatgtgtacgcaccgcctgctgcttctag

SEQ ID NO: 138291 - DNA, 477 bp, Homo sapiens
  Payload ID: 7087
  Gene Symbol: GNAS
  Gene Name: GNAS complex locus
  ENST ID: ENST00000306090
  CDS Start-End: 1-477
atgggctgcctcgggaacagtaagaccgaggaccagcgcaacgaggagaaggcgcagcgtgaggccaacaaaaagatcgagaagcagctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaa

SEQ ID NO: 138292 - DNA, 2578 bp, Homo sapiens
  Payload ID: 7087
  Gene Symbol: GNAS
  Gene Name: GNAS complex locus
  Uniprot ID: O95467
  ENST ID: ENST00000313949
  CDS Start-End: 390-1127
agaacctcactgcccgtccctcctcgcctcagtctcctctgtcctctcccaggcaagaggaccggcggaggcacctctctcgagtcttaggctgcggaatctaagactcagcgagaggagcccgggaggagacagaactttccccttttttcccatcccttcttcttgctcagagaggcaagcaaggcgcggagctttagaaagttcttaagtggtcaggaaggtaggtgcttccctttttctcctcacaaggaggtgaggctgggacctccgggccagcttctcacctcatagggtgtacctttcccggctccagcagccaatgtgcttcggagccactctctgcagagccagagggcaggccggcttctcggtgtgtgcctaagaggatggatcggaggtcccgggctcagcagtggcgccgagctcgccataattacaacgacctgtgcccgcccataggccgccgggcagccaccgcgctcctctggctctcctgctccatcgcgctcctccgcgcccttgccacctccaacgcccgtgcccagcagcgcgcggctgcccaacagcgccggagcttccttaacgcccaccaccgctccggcgcccaggtattccctgagtcccccgaatcggaatctgaccacgagcacgaggaggcagaccttgagctgtccctccccgagtgcctagagtacgaggaagagttcgactacgagaccgagagcgagaccgagtccgaaatcgagtccgagaccgacttcgagaccgagcctgagaccgcccccaccactgagcccgagaccgagcctgaagacgatcgcggcccggtggtgcccaagcactccaccttcggccagtccctcacccagcgtctgcacgctctcaagttgcgaagccccgacgcctccccaagtcgcgcgccgcccagcactcaggagccccagagccccagggaaggggaggagctcaagcccgaggacaaagatccaagggaccccgaagagtcgaaggagcccaaggaggagaagcagcggcgtcgctgcaagccaaagaagcccacccgccgtgacgcgtccccggagtccccttccaaaaagggacccatccccatccggcgtcactaatggaggacgccgtccagattctccttgttttcatggattcaggtgctggagaatctggtaaaagcaccattgtgaagcagatgaggatcctgcatgttaatgggtttaatggagagggcggcgaagaggacccgcaggctgcaaggagcaacagcgatggtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaa

SEQ ID NO: 138293 - DNA, 641 bp, Homo sapiens
  Payload ID: 7087
  Gene Symbol: GNAS
  Gene Name: GNAS complex locus
  ENST ID: ENST00000338783
  CDS Start-End: 1-186
cagcgcaacgaggagaaggcgcagcgtgaggccaacaaaaagatcgagaagcagctgcagaaggacaagcaggtctaccgggccacgcaccgcctgctgctgctgggtgctggagaatctggtaaaagcaccattgtgaagcagatgaggatcctgcatgttaatgggtttaatggagaaatataatatccctagatgatggctacagtttctcatcttcccggctatgtcctatcacaatttgcatgctggaattgctcggtcttaggaacttctaataagaatactattctgttatctgaggggggaggggggatggggcccctgctacctgaccttaaacgatgattgaaaaaacgaaaaatgaactgaaatccttaattggcagaaatgtagtatgacaactatccaaaaaggcatctctataagaaatgactaattgacaatctgctgtaccaaaagttggcatttgagcaagatatgacaagtccttagtgagcaacctactgtgtactagatgtcctgctaaacccttgaaccctactaataccttggcctgcacgtctctctcactctgttctgcaagtcaatataagtattaacattcgtgataaataaaaattctctgcatgtttcagcaa

SEQ ID NO: 138294 - DNA, 1975 bp, Homo sapiens
  Payload ID: 7087
  Gene Symbol: GNAS
  Gene Name: GNAS complex locus
  Uniprot ID: P63092
  ENST ID: ENST00000354359
  CDS Start-End: 425-1612
tcgccgccgccgcctcctcctccccccgcctccccccgcccgccgcggcgcttttggctcggggcggcggcgggggcccggccgaggcaataagagcggcggcggcggcagcggcggcagcagctcccgcagctcctgctctggtccgcctcggcccggcggcggccatcagccccctcggcctcggctcgaggggcggggagctgcgcgcgcccctcggtccgaccgacaccctccccttcccgcccgtccgcgcgccccgcggcccgcggcccgcagtccgccccgcgcgctccttgccgaggagccgagcccgcgcccggcccgcccgcccggcgctgccccggccctcccggcccgcgtgaggccgcccgcgcccgccgccgccgcagcccggccgcgccccgccgccgccgccgccgccatgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtgctggagaatctggtaaaagcaccattgtgaagcagatgaggatcctgcatgttaatgggtttaatggagagggcggcgaagaggacccgcaggctgcaaggagcaacagcgatggcagtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaa

SEQ ID NO: 138295 - DNA, 2551 bp, Homo sapiens
  Payload ID: 7087
  Gene Symbol: GNAS
  Gene Name: GNAS complex locus
  Uniprot ID: O95467
  ENST ID: ENST00000371075
  CDS Start-End: 360-1097
agtctcctctgtcctctcccaggcaagaggaccggcggaggcacctctctcgagtcttaggctgcggaatctaagactcagcgagaggagcccgggaggagacagaactttccccttttttcccatcccttcttcttgctcagagaggcaagcaaggcgcggagctttagaaagttcttaagtggtcaggaaggtaggtgcttccctttttctcctcacaaggaggtgaggctgggacctccgggccagcttctcacctcatagggtgtacctttcccggctccagcagccaatgtgcttcggagccactctctgcagagccagagggcaggccggcttctcggtgtgtgcctaagaggatggatcggaggtcccgggctcagcagtggcgccgagctcgccataattacaacgacctgtgcccgcccataggccgccgggcagccaccgcgctcctctggctctcctgctccatcgcgctcctccgcgcccttgccacctccaacgcccgtgcccagcagcgcgcggctgcccaacagcgccggagcttccttaacgcccaccaccgctccggcgcccaggtattccctgagtcccccgaatcggaatctgaccacgagcacgaggaggcagaccttgagctgtccctccccgagtgcctagagtacgaggaagagttcgactacgagaccgagagcgagaccgagtccgaaatcgagtccgagaccgacttcgagaccgagcctgagaccgcccccaccactgagcccgagaccgagcctgaagacgatcgcggcccggtggtgcccaagcactccaccttcggccagtccctcacccagcgtctgcacgctctcaagttgcgaagccccgacgcctccccaagtcgcgcgccgcccagcactcaggagccccagagccccagggaaggggaggagctcaagcccgaggacaaagatccaagggaccccgaagagtcgaaggagcccaaggaggagaagcagcggcgtcgctgcaagccaaagaagcccacccgccgtgacgcgtccccggagtccccttccaaaaagggacccatccccatccggcgtcactaatggaggacgccgtccagattctccttgttttcatggattcaggtgctggagaatctggtaaaagcaccattgtgaagcagatgaggatcctgcatgttaatgggtttaatggagagggcggcgaagaggacccgcaggctgcaaggagcaacagcgatggcagtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaa

SEQ ID NO: 138296 - DNA, 730 bp, Homo sapiens
  Payload ID: 7087
  Gene Symbol: GNAS
  Gene Name: GNAS complex locus
  ENST ID: ENST00000371081
  CDS Start-End: 12-275
ccgccgccgccatgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtgctggagaatctggtaaaagcaccattgtgaagcagatgaggatcctgcatgttaatgggtttaatggagagggcggcgaagaggacccgcaggctgcaaggagcaacagcgatggaatataatatccctagatgatggctacagtttctcatcttcccggctatgtcctatcacaatttgcatgctggaattgctcggtcttaggaacttctaataagaatactattctgttatctgaggggggaggggggatggggcccctgctacctgaccttaaacgatgattgaaaaaacgaaaaatgaactgaaatccttaattggcagaaatgtagtatgacaactatccaaaaaggcatctctataagaaatgactaattgacaatctgctgtaccaaaagttggcatttgagcaagatatgacaagtccttagtgagcaacctactgtgtactagatgtcctgctaaacccttgaaccctactaataccttggcctgcacgtctctctcactctgttctgcaagtcaatataagtattaacattcgtgataaataaaaattctctgcatgtttcagcaa

SEQ ID NO: 138297 - DNA, 1972 bp, Homo sapiens
  Payload ID: 7087
  Gene Symbol: GNAS
  Gene Name: GNAS complex locus
  Uniprot ID: P63092
  ENST ID: ENST00000371085
  CDS Start-End: 425-1609
tcgccgccgccgcctcctcctccccccgcctccccccgcccgccgcggcgcttttggctcggggcggcggcgggggcccggccgaggcaataagagcggcggcggcggcagcggcggcagcagctcccgcagctcctgctctggtccgcctcggcccggcggcggccatcagccccctcggcctcggctcgaggggcggggagctgcgcgcgcccctcggtccgaccgacaccctccccttcccgcccgtccgcgcgccccgcggcccgcggcccgcagtccgccccgcgcgctccttgccgaggagccgagcccgcgcccggcccgcccgcccggcgctgccccggccctcccggcccgcgtgaggccgcccgcgcccgccgccgccgcagcccggccgcgccccgccgccgccgccgccgccatgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtgctggagaatctggtaaaagcaccattgtgaagcagatgaggatcctgcatgttaatgggtttaatggagagggcggcgaagaggacccgcaggctgcaaggagcaacagcgatggtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaa

SEQ ID NO: 138298 - DNA, 1931 bp, Homo sapiens
  Payload ID: 7087
  Gene Symbol: GNAS
  Gene Name: GNAS complex locus
  Uniprot ID: P63092
  ENST ID: ENST00000371095
  CDS Start-End: 426-1568
ctcgccgccgccgcctcctcctccccccgcctccccccgcccgccgcggcgcttttggctcggggcggcggcgggggcccggccgaggcaataagagcggcggcggcggcagcggcggcagcagctcccgcagctcctgctctggtccgcctcggcccggcggcggccatcagccccctcggcctcggctcgaggggcggggagctgcgcgcgcccctcggtccgaccgacaccctccccttcccgcccgtccgcgcgccccgcggcccgcggcccgcagtccgccccgcgcgctccttgccgaggagccgagcccgcgcccggcccgcccgcccggcgctgccccggccctcccggcccgcgtgaggccgcccgcgcccgccgccgccgcagcccggccgcgccccgccgccgccgccgccgccatgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtgctggagaatctggtaaaagcaccattgtgaagcagatgaggatcctgcatgttaatgggtttaatggagacagtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaa

SEQ ID NO: 138299 - DNA, 1719 bp, Homo sapiens
  Payload ID: 7087
  Gene Symbol: GNAS
  Gene Name: GNAS complex locus
  Uniprot ID: O95467
  ENST ID: ENST00000371098
  CDS Start-End: 360-1097
agtctcctctgtcctctcccaggcaagaggaccggcggaggcacctctctcgagtcttaggctgcggaatctaagactcagcgagaggagcccgggaggagacagaactttccccttttttcccatcccttcttcttgctcagagaggcaagcaaggcgcggagctttagaaagttcttaagtggtcaggaaggtaggtgcttccctttttctcctcacaaggaggtgaggctgggacctccgggccagcttctcacctcatagggtgtacctttcccggctccagcagccaatgtgcttcggagccactctctgcagagccagagggcaggccggcttctcggtgtgtgcctaagaggatggatcggaggtcccgggctcagcagtggcgccgagctcgccataattacaacgacctgtgcccgcccataggccgccgggcagccaccgcgctcctctggctctcctgctccatcgcgctcctccgcgcccttgccacctccaacgcccgtgcccagcagcgcgcggctgcccaacagcgccggagcttccttaacgcccaccaccgctccggcgcccaggtattccctgagtcccccgaatcggaatctgaccacgagcacgaggaggcagaccttgagctgtccctccccgagtgcctagagtacgaggaagagttcgactacgagaccgagagcgagaccgagtccgaaatcgagtccgagaccgacttcgagaccgagcctgagaccgcccccaccactgagcccgagaccgagcctgaagacgatcgcggcccggtggtgcccaagcactccaccttcggccagtccctcacccagcgtctgcacgctctcaagttgcgaagccccgacgcctccccaagtcgcgcgccgcccagcactcaggagccccagagccccagggaaggggaggagctcaagcccgaggacaaagatccaagggaccccgaagagtcgaaggagcccaaggaggagaagcagcggcgtcgctgcaagccaaagaagcccacccgccgtgacgcgtccccggagtccccttccaaaaagggacccatccccatccggcgtcactaatggaggacgccgtccagattctccttgttttcatggattcaggtgctggagaatctggtaaaagcaccattgtgaagcagatgaggatcctgcatgttaatgggtttaatggagagggcggcgaagaggacccgcaggctgcaaggagcaacagcgatggaatataatatccctagatgatggctacagtttctcatcttcccggctatgtcctatcacaatttgcatgctggaattgctcggtcttaggaacttctaataagaatactattctgttatctgaggggggaggggggatggggcccctgctacctgaccttaaacgatgattgaaaaaacgaaaaatgaactgaaatccttaattggcagaaatgtagtatgacaactatccaaaaaggcatctctataagaaatgactaattgacaatctgctgtaccaaaagttggcatttgagcaagatatgacaagtccttagtgagcaacctactgtgtactagatgtcctgctaaacccttgaaccctactaataccttggcctgcacgtctctctcactctgttctgcaagtcaatataagtattaacattcgtgataaataaaaattctctgcatgtttcagcaa

SEQ ID NO: 138300 - DNA, 3709 bp, Homo sapiens
  Payload ID: 7087
  Gene Symbol: GNAS
  Gene Name: GNAS complex locus
  ENST ID: ENST00000371099
  CDS Start-End: 4-2166
gttatgggcgtgcgcaactgcctctacggcaataatatgtcaggacaacgcgatatcccccctgaaatcggggaacagcccgagcaaccacctttggaggccccaggggcagctgcccccggtgctgggcctagcccagccgaagagatggagaccgaaccgcctcacaacgagcccatccccgtcgagaatgatggcgaggcctgtggacccccagaggtctccagacccaactttcaggtcctcaacccggcattcagggaagctggagcccatggaagctacagcccacctcctgaggaagcaatgcccttcgaggctgaacagcccagcttgggaggcttctggcctacactggagcagcctggattccccagtggggtccatgcaggccttgaggccttcggcccagcactcatggagcccggagccttcagtggtgccagaccaggcctgggaggatacagccctccaccagaagaagctatgccctttgagtttgaccagcctgcccagagaggctgcagtcaacttctcttacaggtcccagaccttgctccaggaggcccaggtgctgcaggggtccccggagctcctcccgaggagccccaagccctcaggcctgcaaaggctggctccagaggaggctacagccctccccctgaggagactatgccatttgagcttgatggagaaggatttggggacgacagcccacccccggggctttcccgagttatcgcacaagtcgacggcagcagccagttcgcggcagtcgcggcctcgagtgcggtccgcctcactcccgccgcgaacgcgcctcccctctgggtcccaggcgccatcggcagcccatcccaagaggctgtcagacctccttctaacttcacgggcagcagcccctggatggagatctccggacccccgttcgagattggcagcgcccccgctggggtcgacgacactcccgtcaacatggacagccccccaatcgcgcttgacggcccgcccatcaaggtctccggagccccagataagagagagcgagcagagagacccccagttgaggaggaagcagcagagatggaaggagccgctgatgccgcggagggaggaaaagtaccctctccggggtacggatcccctgccgccggggcagcctcagcggataccgctgccagggcagcccctgcagccccagccgatcctgactccggggcaaccccagaagatcccgactccgggacagcaccagccgatcctgactccggggcattcgcagccgatcccgactccggggcagcccctgccgccccagccgatcccgactccggggcggcccctgacgccccagccgatcccgactccggggcggcccctgacgccccagccgatccagatgccggggcggcccctgaggctcccgccgcccctgcggctgctgagacccgggcagcccatgtcgccccagctgcgccagacgcaggggctcccactgccccagccgcttctgccacccgggcagcccaagtccgccgggcggcctctgcagcccctgcctccggggccagacgcaagatccatctcagaccccccagccccgagatccaggctgccgatccgcctactccgcggcctactcgcgcgtctgcctggcggggcaagtccgagagcagccgcggccgccgcgtgtactacgatgaaggggtggccagcagcgacgatgactccagcggagacgagtccgacgatgggacctccggatgcctccgctggtttcagcatcggcgaaatcgccgccgccgaaagccccagcgcaacttactccgcaactttctcgtgcaagccttcgggggctgcttcggtcgatctgagagtccccagcccaaagcctcgcgctctctcaaggtcaagaaggtacccctggcggagaagcgcagacagatgcgcaaagaagccctggagaagcgggcccagaagcgcgcagagaagaaacgcagtaagctcatcgacaaacaactccaggacgaaaagatgggctacatgtgtacgcaccgcctgctgcttctagggagaaaagtggtgccgagcgacactgagggtcgtttccggctggacaggccagcgccagcaaccgtaagctggacaggcaggggcttcaggtgagccaggaactgccggggaggggccccggggccccgggactcccctggctaggctggtggggtccacggtgggctggggtcattggggaaggcgcgccccgcctcgcctggcacggctgcttggactcagacagcttgtcgttggtgtgtgttggtgtccatattctgtgttcgcctgtgcatgatacgctgaagtgtcccctgttcctatcccggcacccccaaattacccgccgactgtgtacttgtacttgggaacgggctgtgttgtggtttgcgccatggcccgggcaaaaaactttcgctgttcgcacactctggtggtacctgcgcccgggcgctctgcggcaagcggtgcggaggacacgcggggaaggtggcggggcctcccgggaaataagcggggcccttggcctgggggagcggggaatcgcttttcgccggcctccgcgtaaccttgtttctgtatgtctttctctctttttccttttgcgctaagcgtttcctcacttctcattcgttcgccaaaccctcccgcctttacagttgaaaaaccagacacacaggtatctggggcgcccggggctgcacacctcagttcggtattctgcacacacacagctcgcctggtcgggggatgggggaaaggggaaacacaacctgctgtaggcaagtccggatcccaaaccacttgggggctggttccaagggggtgggcgtggctgtgtttaaaaaatatgaaataatttttcttcctagcgaagagcccgaggtaagccaatcatttttacaaagagtacagtaggaggggcttggtttaaaaagatgggggttatgtgttgtgagtggaatgtcacctttgtgtttgaaatgcaactaaaataaaagttttcaaaaaatgctctgagtgtatttgaagtgtgtggacaaagtatggcaaaaccgtgaatatgacttgtgaaaacaagtaaatgtttgcatgtgaattttttcaggcagctttagctgggggcaaagaggcttgtcaaaggtaaggtcttctgcaaattggctctggatacaaaaaatatataaaggtattttgattacagaagttaaaaatcatgatattcttgtcaggagggtattttggtggccttctaccttccccctcctcctctgctcacatttccccacctctcggtgccctcccctctccaggatccccctcctcaccccacagcaagaccctctcctgtatctcccagtctttccctggccattcccagttccccaccctccccccagccccccaagacttcttaacttcaaatctggggcattaaatatttttgccacatttaaacaaagcatcaattagcaatggtctgaatatgtggtttaaatgaaaacttccaaacaaacttcacaagcttaatttttacattttattctctaagactttctctaagaccttccaagggatttcaagatcacagtttttaaggctgcgctacatttgttaaatatgttagaatgtgtgatggttttttattaatggcatt

SEQ ID NO: 138301 - DNA, 4029 bp, Homo sapiens
  Payload ID: 7087
  Gene Symbol: GNAS
  Gene Name: GNAS complex locus
  Uniprot ID: Q5JWF2
  ENST ID: ENST00000371100
  CDS Start-End: 553-3666
aaagactccaaatcagtcagggagaggagtggaaggagccaaaacgtccctgcgaggcctgcgctcaccagcccccttacccaaagtcccgggcccctggcgccaggagcaggctcctggagccggagccagctcggcactggaaccggcgtcctctggtggcagagagagagcgctactggcgattttcggaccgaatcggcacgctcgtcagatccaagcaggcgggactggcctggagcaaaaagaaagagagaggagggcgtaaggatagaccaaggaagaggggctggggggcagcctgggggcatgaaaagtggccaggaaggagccaagactccaccagcaacaattgagttgcttcagcctcagtctagggttccttccaggccttgaaccccccaacctcacaagggttggaaagtgaggccggtgaactttccagctggtactttgattttaaaataataataataattttttcaccctagttcggttgggtgctccatcttacggagccccaaacttattttgagaggccgccaccgtgttatgggcgtgcgcaactgcctctacggcaataatatgtcaggacaacgcgatatcccccctgaaatcggggaacagcccgagcaaccacctttggaggccccaggggcagctgcccccggtgctgggcctagcccagccgaagagatggagaccgaaccgcctcacaacgagcccatccccgtcgagaatgatggcgaggcctgtggacccccagaggtctccagacccaactttcaggtcctcaacccggcattcagggaagctggagcccatggaagctacagcccacctcctgaggaagcaatgcccttcgaggctgaacagcccagcttgggaggcttctggcctacactggagcagcctggattccccagtggggtccatgcaggccttgaggccttcggcccagcactcatggagcccggagccttcagtggtgccagaccaggcctgggaggatacagccctccaccagaagaagctatgccctttgagtttgaccagcctgcccagagaggctgcagtcaacttctcttacaggtcccagaccttgctccaggaggcccaggtgctgcaggggtccccggagctcctcccgaggagccccaagccctcaggcctgcaaaggctggctccagaggaggctacagccctccccctgaggagactatgccatttgagcttgatggagaaggatttggggacgacagcccacccccggggctttcccgagttatcgcacaagtcgacggcagcagccagttcgcggcagtcgcggcctcgagtgcggtccgcctcactcccgccgcgaacgcgcctcccctctgggtcccaggcgccatcggcagcccatcccaagaggctgtcagacctccttctaacttcacgggcagcagcccctggatggagatctccggacccccgttcgagattggcagcgcccccgctggggtcgacgacactcccgtcaacatggacagccccccaatcgcgcttgacggcccgcccatcaaggtctccggagccccagataagagagagcgagcagagagacccccagttgaggaggaagcagcagagatggaaggagccgctgatgccgcggagggaggaaaagtaccctctccggggtacggatcccctgccgccggggcagcctcagcggataccgctgccagggcagcccctgcagccccagccgatcctgactccggggcaaccccagaagatcccgactccgggacagcaccagccgatcctgactccggggcattcgcagccgatcccgactccggggcagcccctgccgccccagccgatcccgactccggggcggcccctgacgccccagccgatcccgactccggggcggcccctgacgccccagccgatccagatgccggggcggcccctgaggctcccgccgcccctgcggctgctgagacccgggcagcccatgtcgccccagctgcgccagacgcaggggctcccactgccccagccgcttctgccacccgggcagcccaagtccgccgggcggcctctgcagcccctgcctccggggccagacgcaagatccatctcagaccccccagccccgagatccaggctgccgatccgcctactccgcggcctactcgcgcgtctgcctggcggggcaagtccgagagcagccgcggccgccgcgtgtactacgatgaaggggtggccagcagcgacgatgactccagcggagacgagtccgacgatgggacctccggatgcctccgctggtttcagcatcggcgaaatcgccgccgccgaaagccccagcgcaacttactccgcaactttctcgtgcaagccttcgggggctgcttcggtcgatctgagagtccccagcccaaagcctcgcgctctctcaaggtcaagaaggtacccctggcggagaagcgcagacagatgcgcaaagaagccctggagaagcgggcccagaagcgcgcagagaagaaacgcagtaagctcatcgacaaacaactccaggacgaaaagatgggctacatgtgtacgcaccgcctgctgcttctaggtgctggagaatctggtaaaagcaccattgtgaagcagatgaggatcctgcatgttaatgggtttaatggagagggcggcgaagaggacccgcaggctgcaaggagcaacagcgatggtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaa

SEQ ID NO: 138302 - DNA, 3438 bp, Homo sapiens
  Payload ID: 7087
  Gene Symbol: GNAS
  Gene Name: GNAS complex locus
  Uniprot ID: Q5JWF2
  ENST ID: ENST00000371102
  CDS Start-End: 4-3075
gttatgggcgtgcgcaactgcctctacggcaataatatgtcaggacaacgcgatatcccccctgaaatcggggaacagcccgagcaaccacctttggaggccccaggggcagctgcccccggtgctgggcctagcccagccgaagagatggagaccgaaccgcctcacaacgagcccatccccgtcgagaatgatggcgaggcctgtggacccccagaggtctccagacccaactttcaggtcctcaacccggcattcagggaagctggagcccatggaagctacagcccacctcctgaggaagcaatgcccttcgaggctgaacagcccagcttgggaggcttctggcctacactggagcagcctggattccccagtggggtccatgcaggccttgaggccttcggcccagcactcatggagcccggagccttcagtggtgccagaccaggcctgggaggatacagccctccaccagaagaagctatgccctttgagtttgaccagcctgcccagagaggctgcagtcaacttctcttacaggtcccagaccttgctccaggaggcccaggtgctgcaggggtccccggagctcctcccgaggagccccaagccctcaggcctgcaaaggctggctccagaggaggctacagccctccccctgaggagactatgccatttgagcttgatggagaaggatttggggacgacagcccacccccggggctttcccgagttatcgcacaagtcgacggcagcagccagttcgcggcagtcgcggcctcgagtgcggtccgcctcactcccgccgcgaacgcgcctcccctctgggtcccaggcgccatcggcagcccatcccaagaggctgtcagacctccttctaacttcacgggcagcagcccctggatggagatctccggacccccgttcgagattggcagcgcccccgctggggtcgacgacactcccgtcaacatggacagccccccaatcgcgcttgacggcccgcccatcaaggtctccggagccccagataagagagagcgagcagagagacccccagttgaggaggaagcagcagagatggaaggagccgctgatgccgcggagggaggaaaagtaccctctccggggtacggatcccctgccgccggggcagcctcagcggataccgctgccagggcagcccctgcagccccagccgatcctgactccggggcaaccccagaagatcccgactccgggacagcaccagccgatcctgactccggggcattcgcagccgatcccgactccggggcagcccctgccgccccagccgatcccgactccggggcggcccctgacgccccagccgatcccgactccggggcggcccctgacgccccagccgatccagatgccggggcggcccctgaggctcccgccgcccctgcggctgctgagacccgggcagcccatgtcgccccagctgcgccagacgcaggggctcccactgccccagccgcttctgccacccgggcagcccaagtccgccgggcggcctctgcagcccctgcctccggggccagacgcaagatccatctcagaccccccagccccgagatccaggctgccgatccgcctactccgcggcctactcgcgcgtctgcctggcggggcaagtccgagagcagccgcggccgccgcgtgtactacgatgaaggggtggccagcagcgacgatgactccagcggagacgagtccgacgatgggacctccggatgcctccgctggtttcagcatcggcgaaatcgccgccgccgaaagccccagcgcaacttactccgcaactttctcgtgcaagccttcgggggctgcttcggtcgatctgagagtccccagcccaaagcctcgcgctctctcaaggtcaagaaggtacccctggcggagaagcgcagacagatgcgcaaagaagccctggagaagcgggcccagaagcgcgcagagaagaaacgcagtaagctcatcgacaaacaactccaggacgaaaagatgggctacatgtgtacgcaccgcctgctgcttctaggtgctggagaatctggtaaaagcaccattgtgaagcagatgaggatcctgcatgttaatgggtttaatggagacagtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaa

SEQ ID NO: 138303 - DNA, 632 bp, Homo sapiens
  Payload ID: 7087
  Gene Symbol: GNAS
  Gene Name: GNAS complex locus
  ENST ID: ENST00000453292
  CDS Start-End: 1-501
cccgaatcggaatctgaccacgagcacgaggaggcagaccttgagctgtccctccccgagtgcctagagtacgaggaagagttcgactacgagaccgagagcgagaccgagtccgaaatcgagtccgagaccgacttcgagaccgagcctgagaccgcccccaccactgagcccgagaccgagcctgaagacgatcgcggcccggtggtgcccaagcactccaccttcggccagtccctcacccagcgtctgcacgctctcaagttgcgaagccccgacgcctccccaagtcgcgcgccgcccagcactcaggagccccagagccccagggaaggggaggagctcaagcccgaggacaaagatccaagggaccccgaagagtcgaaggagcccaaggaggagaagcagcggcgtcgctgcaagccaaagaagcccacccgccgtgacgcgtccccggagtccccttccaaaaagggacccatccccatccggcgtcactaatggaggacgccgtccagattctccttgttttcatggattcaggtgctggagaatctggtaaaagcaccattgtgaagcagatgaggatcctgcatgttaatgggtttaatggagacagtgagaaggcaacc

SEQ ID NO: 138304 - DNA, 736 bp, Homo sapiens
  Payload ID: 7087
  Gene Symbol: GNAS
  Gene Name: GNAS complex locus
  ENST ID: ENST00000423897
  CDS Start-End: 1-281
aggtacccctggcggagaagcgcagacagatgcgcaaagaagccctggagaagcgggcccagaagcgcgcagagaagaaacgcagtaagctcatcgacaaacaactccaggacgaaaagatgggctacatgtgtacgcaccgcctgctgcttctaggtgctggagaatctggtaaaagcaccattgtgaagcagatgaggatcctgcatgttaatgggtttaatggagagggcggcgaagaggacccgcaggctgcaaggagcaacagcgatggaatataatatccctagatgatggctacagtttctcatcttcccggctatgtcctatcacaatttgcatgctggaattgctcggtcttaggaacttctaataagaatactattctgttatctgaggggggaggggggatggggcccctgctacctgaccttaaacgatgattgaaaaaacgaaaaatgaactgaaatccttaattggcagaaatgtagtatgacaactatccaaaaaggcatctctataagaaatgactaattgacaatctgctgtaccaaaagttggcatttgagcaagatatgacaagtccttagtgagcaacctactgtgtactagatgtcctgctaaacccttgaaccctactaataccttggcctgcacgtctctctcactctgttctgcaagtcaatataagtattaacattcgtgataaataaaaattctctgcatgtttcagcaa

SEQ ID NO: 138305 - DNA, 595 bp, Homo sapiens
  Payload ID: 7087
  Gene Symbol: GNAS
  Gene Name: GNAS complex locus
  ENST ID: ENST00000450130
  CDS Start-End: 1-595
agccttcgggggctgcttcggtcgatctgagagtccccagcccaaagcctcgcgctctctcaaggtcaagaaggtacccctggcggagaagcgcagacagatgcgcaaagaagccctggagaagcgggcccagaagcgcgcagagaagaaacgcagtaagctcatcgacaaacaactccaggacgaaaagatgggctacatgtgtacgcaccgcctgctgcttctaggtgctggagaatctggtaaaagcaccattgtgaagcagatgaggatcctgcatgttaatgggtttaatggagatgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtg

SEQ ID NO: 138306 - DNA, 729 bp, Homo sapiens
  Payload ID: 7087
  Gene Symbol: GNAS
  Gene Name: GNAS complex locus
  ENST ID: ENST00000419558
  CDS Start-End: 1-341
ccaccactgagcccgagaccgagcctgaagacgatcgcggcccggtggtgcccaagcactccaccttcggccagtccctcacccagcgtctgcacgctctcaagttgcgaagccccgacgcctccccaagtcgcgcgccgcccagcactcaggagccccagagccccagggaaggggaggagctcaagcccgaggacaaagatccaagggaccccgaagagtcgaaggagcccaaggaggagaagcagcggcgtcgctgcaagccaaagaagcccacccgccgtgacgcgtccccggagtccccttccaaaaagggacccatccccatccggcgtcactaatggaggacgccgtccagattctccttgttttcatggattcaggtgctggagaatctggtaaaagcaccattgtgaagcagatgaggatcctgcatgttaatgggtttaatggagatgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagta

SEQ ID NO: 138307 - DNA, 693 bp, Homo sapiens
  Payload ID: 7087
  Gene Symbol: GNAS
  Gene Name: GNAS complex locus
  ENST ID: ENST00000604005
  CDS Start-End: 212-693
gctccccggcggggacactcagtcgcgtcggcaccgcggagcgggctgcgtcaggtggctggccggcgcggcgctcccctgctctctggctccgggctgcggcgcggcggctggagcgagcccctgtcccggcgcggggcggcggcgggcggccggcaggcgctgccttgcgtgtgctggagaatctggtaaaagcaccattgtgaagcagatgaggatcctgcatgttaatgggtttaatggagagggcggcgaagaggacccgcaggctgcaaggagcaacagcgatggtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttcca

SEQ ID NO: 138308 - DNA, 573 bp, Homo sapiens
  Payload ID: 7087
  Gene Symbol: GNAS
  Gene Name: GNAS complex locus
  ENST ID: ENST00000603546
  CDS Start-End: 213-573
agatttgttgggagagggaaagaggggaagaaaggggcgaggagaggagggggtgacgctggggggcgccgtggtggcggagggggcctcgccaaagggaggctttggcggggagaagtggccgaggagagtgggggggctggtgacatcagcccctcggaaaggatcggagcggtgctggagaatctggtaaaagcaccattgtgaagcagatgaggatcctgcatgttaatgggtttaatggagagggcggcgaagaggacccgcaggctgcaaggagcaacagcgatggtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctgg

SEQ ID NO: 138309 - DNA, 1721 bp, Homo sapiens
  Payload ID: 7088
  Gene Symbol:
  Gene Name: GNG4
  ENST ID: ENST00000634574
  CDS Start-End: 217-444
cggtgccacagggacgaggcctggagagcagtcgctcctagaaccggggcgcgaagggcacccccgcctccagcacgcgccctccgccctcccggcctcgctccccccggagtgggggcctcgccggcccctggtccccgtcactcagcaacgtcgggtcagccttcgccgggttagtggcgacgcggccgcgcgaattcgcacaggggcagtagaatgaaagagggcatgtctaataacagcaccactagcatctcccaagccaggaaagctgtggagcagctaaagatggaagcctgtatggacagggtcaaggtctcccaggcagctgcggacctcctggcctactgtgaagctcacgtgcgggaagatcctctcatcattccagtgcctgcatcagaaaacccctttcgcgagaagaagttcttttgtaccattctctaactccgtgtgtgatgaaaacgcctccttttctgaccttcaaagtcccctgtagagaccatgcatgctctaagccttagggagtgagaccaacacccatccctgcccagccaacagtggccggggcttgtcttatgtttccatctgttttcttcgtggcattcaatttcatttttttccttttcattttcatgttattttcattattggcaaagaaaatcaaaatgtttatagccaaataacaaatgtgccatgtaaaagtaagtctggacttaagagtttaaaatttttaaacatcagtttccaagtttatatcatattaatacatttcagtggataatttattttaaaaaaaaaactatgcctaaatatcccttatttgcaatattcagtatcaaattagagcattttgaccaactgaaacatataacgttttcatctcctttcctggagaaagcagctgcagaggttctgtatttcctgcatttccatcatcctagtaaaaagacaacaacccacaggattggaatggttttcttttgttttttttttgttgttgttgttgttttgagatggagtctcgctctgtcacccaggctggagtgcaatggcgtgacctcagctcactgcgacctccacctcctgggttcaagcgattctcctgcctcagcctcctgagtagctgggatcataggcacgcgccaccacacccagctaattttttgtatttttagtaaagacggggtttcaccatgttggtcaggctggtctcaaactcctgacctcgtgatccacccgcctcggcctcccaaagcgctgggattacaggcgtgagccaccacacccggccgtggaatggttttcttagcatatcctcctggggccgtggcgccccggctgtgggccgtggtggatgtcccttgtttcagtggtcctacaaaggtagatggtgggcggacaccgaagtcaacttgactgtaaaagtaccccataccgttgacgcgctgtggcagacctgtgggtgcggtctcccctctccaaatgccacctcttcctgctccctcctcttttggctcctactcagtagttccattgtgggctgcagtaatataaggacctgttctggacacagcactgggcccgctggggttttagtagggcagccccttccctgcaggagtgaggcatggtgacagcagtcccctatgtgcccccaagtcatctgagcattggtgtgcattaaggtactcaatcttccaacaataaataccataagtgca

SEQ ID NO: 138310 - DNA, 4978 bp, Homo sapiens
  Payload ID: 7088
  Gene Symbol:
  Gene Name: GNG4
  ENST ID: ENST00000635595
  CDS Start-End: 329-556
cggtgccacagggacgaggcctggagagcagtcgctcctagaaccggggcgcgaagggcacccccgcctccagcacgcgccctccgccctcccggcctcgctccccccggagtgggggcctcgccggcccctggtccccgtcactcagcaacgtcgggtcagccttcgccgggttagtggcgacgcggccgcgcgaattcgcacaggtgacctcaaagcagaagctctgaattcacctctcatctgacgactgacagctgctgccaccgccagcctctgtcccttgcccaggcctgtcacacggctgcctctcagcaggggcagtagaatgaaagagggcatgtctaataacagcaccactagcatctcccaagccaggaaagctgtggagcagctaaagatggaagcctgtatggacagggtcaaggtctcccaggcagctgcggacctcctggcctactgtgaagctcacgtgcgggaagatcctctcatcattccagtgcctgcatcagaaaacccctttcgcgagaagaagttcttttgtaccattctctaactccgtgtgtgatgaaaacgcctccttttctgaccttcaaagtcccctgtagagaccatgcatgctctaagccttagggagtgagaccaacacccatccctgcccagccaacagtggccggggcttgtcttatgtttccatctgttttcttcgtggcattcaatttcatttttttccttttcattttcatgttattttcattattggcaaagaaaatcaaaatgtttatagccaaataacaaatgtgccatgtaaaagtaagtctggacttaagagtttaaaatttttaaacatcagtttccaagtttatatcatattaatacatttcagtggataatttattttaaaaaaaaaactatgcctaaatatcccttatttgcaatattcagtatcaaattagagcattttgaccaactgaaacatataacgttttcatctcctttcctggagaaagcagctgcagaggttctgtatttcctgcatttccatcatcctagtaaaaagacaacaacccacaggattggaatggttttcttttgttttttttttgttgttgttgttgttttgagatggagtctcgctctgtcacccaggctggagtgcaatggcgtgacctcagctcactgcgacctccacctcctgggttcaagcgattctcctgcctcagcctcctgagtagctgggatcataggcacgcgccaccacacccagctaattttttgtatttttagtaaagacggggtttcaccatgttggtcaggctggtctcaaactcctgacctcgtgatccacccgcctcggcctcccaaagcgctgggattacaggcgtgagccaccacacccggccgtggaatggttttcttagcatatcctcctggggccgtggcgccccggctgtgggccgtggtggatgtcccttgtttcagtggtcctacaaaggtagatggtgggcggacaccgaagtcaacttgactgtaaaagtaccccataccgttgacgcgctgtggcagacctgtgggtgcggtctcccctctccaaatgccacctcttcctgctccctcctcttttggctcctactcagtagttccattgtgggctgcagtaatataaggacctgttctggacacagcactgggcccgctggggttttagtagggcagccccttccctgcaggagtgaggcatggtgacagcagtcccctatgtgcccccaagtcatctgagcattggtgtgcattaaggtactcaatcttccaacaataaataccataagtgcatgtctgttttattttatttatttatctttttgagacagagtcttgctctgtcgcccgggctggaatgcaatggcacaatctcagctcaccgcaacctccactcgcaggttcaagtgatcctcatgtctcagcctccctagtagctgggatgacaagcacacgccaacatgcctggctcatttttgtatttttagtagagacggggtttcaccatgtcggccaggctggtctccaactactggcctcgagtgatctgcccaccttggcctcccaaagtgctgggattgcaggtgtgagccagtgcacccggccgtatgtcttagagtgaggggaaactgaggcacaaagcgtttatgtagtttgcccaaggttacacatggtaagcagaaaaactgggatttgagggcaggcagcccggccccagagttcccttagccccctgaactgtgctaccttccaggtctacctgtttgcaggtagggagacccacaaactatcataactgcacaccgtgaagcaaacacctttgttgcagtaacccgtggcacacttcacttcccacattctccaggaggaagccgtattctggtagtttaaggaaggtgattcatggatgccccaaggaaaggctagacatcgatgaattagctcttggattgtctaagatcaacctgaaggtcctacctaaaccaaactcatatgatcccgatgaaagaggagaatacacagtgggagcagagctctttgtgtaagtttgttctattctgtttatttggaaactgcctctctccctagttctgaaagagacttgctgtgtgatagagaacaggccatttgtgcctgaaatgttctaacctgcaaattgggtttaatggtaattatcctgcctttctgtctgggaggaaacagagatgctacatagatgaaagctctgattatcatttaaaacaaataaatgtactaaatgccgtggtataatatagggaagaatggatgacttcaaagagaccatggttccgttggaggcataaaattgcctgcaaagaggcaaatgtaatttccagaccaattaatgacttgctgccctcgtaaatggatttaggacatctttgttccttgcttcttttgttaaaactcattcttagtttcattatcagctcactaataataccagtgttgttaagatgctcaaactagagcagaattgtatgctggatgtgacgctaggacctcagatcctttgatagtgcagttatgaccaggatctctttattctgtgcttcacgtcaacatcattaacccgatgaagcgaagcacaagtcataaaggcacatcagagaagccgagaaagcggggccgtacagagagcatcaaaatcaggtcagaaaaatgctgctttcctcttccaccaaaccttctccctgttgtttttacatgccccgtccctccagattcagcctccgttttgttctctctccttttccttttcctcctctcttccttaccttcccctgtgagatgcttttctgtccttttactgcacctcttccagacctatggcatttggggacgggtcacccttcctagagtgatcctgaatccagctgcctcttctttttttgtttttgtttttgtttttgagacagagtctctttctgtcgtccaggctggagtgcagtagcgcaatcttggctcactgcaacctctgcctcctgggttcaagcgattcttgtgcctcaacctcacgaggagctgggattgcaggcgcccgccaccacacccggctaatttttgtatttttagtagagacggagtttcaccatgttggccacgctggtcttgaagcccagacctcaagtgatccgcccgccttggcctcccaaagtgctgggattacaggcatgagccaccgcgcctggcctagttccctcttcttagatggagatttctgcacatgagctgtgagatccacagacatgtcactgagctcccccactctgtcagtggaagatgaatggaataaagcctgcttgcattgtggagtgcagctgtggggacagttgtcatttttgtgttttcagcttaactgtccagcatctcccctcccttcctacagcagggacatcatgccttagatataaacttagtggtgtgcagtacccaccgtggaagctgaagaagggaagtatttcctgtctctcaggcacaccccgcttccagccccataccagtcgggaagtggtcattgacctggggtggactacctggacccttgcttggggctatgagcctggagaatgtgacacaaatgaagggatgctgagactcatttcaaggaagccaccgtggtccggggttggtagtcatacagcaaggcaggtgggtagggctggcaggctgcagggatggtgtgtccactggtagcaatgtccagggatggcagcgtcctgggaatgtcatttctgctccactccttggactcgctgagctgtctccgcctccacctatcttcctacagacctcccttctagttttctgtcaattctttgagccagcaaactccatccagtacattctttcttctttcatgaaagagcttgagttggatgtaaatatatatgacctaacaattccacccctaggtgtataccctacagaaatgtgtacatgtgttcatccagagacatgctctaaatcttcacaaaaacactctccataataaccccgaacaggaaagcaccccaatgcccatgttggctggataagcacattagggtatattcacacgatggaatcccagactgcaatgggaatgagctgcaactccacccccaacttggagtgtattcaccaaccctagtgttgaacgagataaggcaaaaatgcaccataggattccatttatataaagtttaaaacccagcaaaattcatccatgcggttgcaagtagagatcagtcctaagaagacagtaaccagaagcgggcatgaggtggtgcttctggggtgttctgtttcttgatctggttgccggttacctgggtgctttccgtttgtgaacattcttggagctgtacacttttgatctgggcacttttctgtgtgtatgttatacttcaataaaaagttgggctttgtgactagc

SEQ ID NO: 138311 - DNA, 5104 bp, Homo sapiens
  Payload ID: 7088
  Gene Symbol:
  Gene Name: GNG4
  ENST ID: ENST00000635006
  CDS Start-End: 455-682
gggggcgagggtcgcagagtcgccggctctcccttccccagtctgggcccccacggcacagggggccgagcagaagcccccagcgtccagggccgggggagggtccgcctgcgcccccaggcccgcgtggtcgggccctgcagggcgggaggcgcggcgcggggcggggccggtgacgggacgcggagaccccgcgggcggcgggaggggcacgaggcgcgcgtttgcacccgagcccggcccgcgccccgatgcggagcgatgccgctcggcctggccgccccccgcgagcaccgcgctgcagacgaagcccgcgcgtgatcccgctccgggtgacctcaaagcagaagctctgaattcacctctcatctgacgactgacagctgctgccaccgccagcctctgtcccttgcccaggcctgtcacacggctgcctctcagcaggggcagtagaatgaaagagggcatgtctaataacagcaccactagcatctcccaagccaggaaagctgtggagcagctaaagatggaagcctgtatggacagggtcaaggtctcccaggcagctgcggacctcctggcctactgtgaagctcacgtgcgggaagatcctctcatcattccagtgcctgcatcagaaaacccctttcgcgagaagaagttcttttgtaccattctctaactccgtgtgtgatgaaaacgcctccttttctgaccttcaaagtcccctgtagagaccatgcatgctctaagccttagggagtgagaccaacacccatccctgcccagccaacagtggccggggcttgtcttatgtttccatctgttttcttcgtggcattcaatttcatttttttccttttcattttcatgttattttcattattggcaaagaaaatcaaaatgtttatagccaaataacaaatgtgccatgtaaaagtaagtctggacttaagagtttaaaatttttaaacatcagtttccaagtttatatcatattaatacatttcagtggataatttattttaaaaaaaaaactatgcctaaatatcccttatttgcaatattcagtatcaaattagagcattttgaccaactgaaacatataacgttttcatctcctttcctggagaaagcagctgcagaggttctgtatttcctgcatttccatcatcctagtaaaaagacaacaacccacaggattggaatggttttcttttgttttttttttgttgttgttgttgttttgagatggagtctcgctctgtcacccaggctggagtgcaatggcgtgacctcagctcactgcgacctccacctcctgggttcaagcgattctcctgcctcagcctcctgagtagctgggatcataggcacgcgccaccacacccagctaattttttgtatttttagtaaagacggggtttcaccatgttggtcaggctggtctcaaactcctgacctcgtgatccacccgcctcggcctcccaaagcgctgggattacaggcgtgagccaccacacccggccgtggaatggttttcttagcatatcctcctggggccgtggcgccccggctgtgggccgtggtggatgtcccttgtttcagtggtcctacaaaggtagatggtgggcggacaccgaagtcaacttgactgtaaaagtaccccataccgttgacgcgctgtggcagacctgtgggtgcggtctcccctctccaaatgccacctcttcctgctccctcctcttttggctcctactcagtagttccattgtgggctgcagtaatataaggacctgttctggacacagcactgggcccgctggggttttagtagggcagccccttccctgcaggagtgaggcatggtgacagcagtcccctatgtgcccccaagtcatctgagcattggtgtgcattaaggtactcaatcttccaacaataaataccataagtgcatgtctgttttattttatttatttatctttttgagacagagtcttgctctgtcgcccgggctggaatgcaatggcacaatctcagctcaccgcaacctccactcgcaggttcaagtgatcctcatgtctcagcctccctagtagctgggatgacaagcacacgccaacatgcctggctcatttttgtatttttagtagagacggggtttcaccatgtcggccaggctggtctccaactactggcctcgagtgatctgcccaccttggcctcccaaagtgctgggattgcaggtgtgagccagtgcacccggccgtatgtcttagagtgaggggaaactgaggcacaaagcgtttatgtagtttgcccaaggttacacatggtaagcagaaaaactgggatttgagggcaggcagcccggccccagagttcccttagccccctgaactgtgctaccttccaggtctacctgtttgcaggtagggagacccacaaactatcataactgcacaccgtgaagcaaacacctttgttgcagtaacccgtggcacacttcacttcccacattctccaggaggaagccgtattctggtagtttaaggaaggtgattcatggatgccccaaggaaaggctagacatcgatgaattagctcttggattgtctaagatcaacctgaaggtcctacctaaaccaaactcatatgatcccgatgaaagaggagaatacacagtgggagcagagctctttgtgtaagtttgttctattctgtttatttggaaactgcctctctccctagttctgaaagagacttgctgtgtgatagagaacaggccatttgtgcctgaaatgttctaacctgcaaattgggtttaatggtaattatcctgcctttctgtctgggaggaaacagagatgctacatagatgaaagctctgattatcatttaaaacaaataaatgtactaaatgccgtggtataatatagggaagaatggatgacttcaaagagaccatggttccgttggaggcataaaattgcctgcaaagaggcaaatgtaatttccagaccaattaatgacttgctgccctcgtaaatggatttaggacatctttgttccttgcttcttttgttaaaactcattcttagtttcattatcagctcactaataataccagtgttgttaagatgctcaaactagagcagaattgtatgctggatgtgacgctaggacctcagatcctttgatagtgcagttatgaccaggatctctttattctgtgcttcacgtcaacatcattaacccgatgaagcgaagcacaagtcataaaggcacatcagagaagccgagaaagcggggccgtacagagagcatcaaaatcaggtcagaaaaatgctgctttcctcttccaccaaaccttctccctgttgtttttacatgccccgtccctccagattcagcctccgttttgttctctctccttttccttttcctcctctcttccttaccttcccctgtgagatgcttttctgtccttttactgcacctcttccagacctatggcatttggggacgggtcacccttcctagagtgatcctgaatccagctgcctcttctttttttgtttttgtttttgtttttgagacagagtctctttctgtcgtccaggctggagtgcagtagcgcaatcttggctcactgcaacctctgcctcctgggttcaagcgattcttgtgcctcaacctcacgaggagctgggattgcaggcgcccgccaccacacccggctaatttttgtatttttagtagagacggagtttcaccatgttggccacgctggtcttgaagcccagacctcaagtgatccgcccgccttggcctcccaaagtgctgggattacaggcatgagccaccgcgcctggcctagttccctcttcttagatggagatttctgcacatgagctgtgagatccacagacatgtcactgagctcccccactctgtcagtggaagatgaatggaataaagcctgcttgcattgtggagtgcagctgtggggacagttgtcatttttgtgttttcagcttaactgtccagcatctcccctcccttcctacagcagggacatcatgccttagatataaacttagtggtgtgcagtacccaccgtggaagctgaagaagggaagtatttcctgtctctcaggcacaccccgcttccagccccataccagtcgggaagtggtcattgacctggggtggactacctggacccttgcttggggctatgagcctggagaatgtgacacaaatgaagggatgctgagactcatttcaaggaagccaccgtggtccggggttggtagtcatacagcaaggcaggtgggtagggctggcaggctgcagggatggtgtgtccactggtagcaatgtccagggatggcagcgtcctgggaatgtcatttctgctccactccttggactcgctgagctgtctccgcctccacctatcttcctacagacctcccttctagttttctgtcaattctttgagccagcaaactccatccagtacattctttcttctttcatgaaagagcttgagttggatgtaaatatatatgacctaacaattccacccctaggtgtataccctacagaaatgtgtacatgtgttcatccagagacatgctctaaatcttcacaaaaacactctccataataaccccgaacaggaaagcaccccaatgcccatgttggctggataagcacattagggtatattcacacgatggaatcccagactgcaatgggaatgagctgcaactccacccccaacttggagtgtattcaccaaccctagtgttgaacgagataaggcaaaaatgcaccataggattccatttatataaagtttaaaacccagcaaaattcatccatgcggttgcaagtagagatcagtcctaagaagacagtaaccagaagcgggcatgaggtggtgcttctggggtgttctgtttcttgatctggttgccggttacctgggtgctttccgtttgtgaacattcttggagctgtacacttttgatctgggcacttttctgtgtgtatgttatacttcaataaaaagttgggctttgtgactagc

SEQ ID NO: 138312 - DNA, 684 bp, Homo sapiens
  Payload ID: 7088
  Gene Symbol:
  Gene Name: GNG4
  ENST ID: ENST00000635387
  CDS Start-End: 102-329
ggccctgccggcagggcagcaagtcgggagcagctgtgggtggtgtcctacaggctctgctgtggaggaagagctgctgccctgagtggaggggcagtagaatgaaagagggcatgtctaataacagcaccactagcatctcccaagccaggaaagctgtggagcagctaaagatggaagcctgtatggacagggtcaaggtctcccaggcagctgcggacctcctggcctactgtgaagctcacgtgcgggaagatcctctcatcattccagtgcctgcatcagaaaacccctttcgcgagaagaagttcttttgtaccattctctaactccgtgtgtgatgaaaacgcctccttttctgaccttcaaagtcccctgtagagaccatgcatgctctaagccttagggagtgagaccaacacccatccctgcccagccaacagtggccggggcttgtcttatgtttccatctgttttcttcgtggcattcaatttcatttttttccttttcattttcatgttattttcattattggcaaagaaaatcaaaatgtttatagccaaataacaaatgtgccatgtaaaagtaagtctggacttaagagtttaaaatttttaaacatcagtttccaagtttatatcatattaatacatttcagtggataatttattttaaaaaaaaaa

SEQ ID NO: 138313 - DNA, 1595 bp, Homo sapiens
  Payload ID: 7088
  Gene Symbol:
  Gene Name: GNG4
  ENST ID: ENST00000635235
  CDS Start-End: 91-318
ctcatctgacgactgacagctgctgccaccgccagcctctgtcccttgcccaggcctgtcacacggctgcctctcagcaggggcagtagaatgaaagagggcatgtctaataacagcaccactagcatctcccaagccaggaaagctgtggagcagctaaagatggaagcctgtatggacagggtcaaggtctcccaggcagctgcggacctcctggcctactgtgaagctcacgtgcgggaagatcctctcatcattccagtgcctgcatcagaaaacccctttcgcgagaagaagttcttttgtaccattctctaactccgtgtgtgatgaaaacgcctccttttctgaccttcaaagtcccctgtagagaccatgcatgctctaagccttagggagtgagaccaacacccatccctgcccagccaacagtggccggggcttgtcttatgtttccatctgttttcttcgtggcattcaatttcatttttttccttttcattttcatgttattttcattattggcaaagaaaatcaaaatgtttatagccaaataacaaatgtgccatgtaaaagtaagtctggacttaagagtttaaaatttttaaacatcagtttccaagtttatatcatattaatacatttcagtggataatttattttaaaaaaaaaactatgcctaaatatcccttatttgcaatattcagtatcaaattagagcattttgaccaactgaaacatataacgttttcatctcctttcctggagaaagcagctgcagaggttctgtatttcctgcatttccatcatcctagtaaaaagacaacaacccacaggattggaatggttttcttttgttttttttttgttgttgttgttgttttgagatggagtctcgctctgtcacccaggctggagtgcaatggcgtgacctcagctcactgcgacctccacctcctgggttcaagcgattctcctgcctcagcctcctgagtagctgggatcataggcacgcgccaccacacccagctaattttttgtatttttagtaaagacggggtttcaccatgttggtcaggctggtctcaaactcctgacctcgtgatccacccgcctcggcctcccaaagcgctgggattacaggcgtgagccaccacacccggccgtggaatggttttcttagcatatcctcctggggccgtggcgccccggctgtgggccgtggtggatgtcccttgtttcagtggtcctacaaaggtagatggtgggcggacaccgaagtcaacttgactgtaaaagtaccccataccgttgacgcgctgtggcagacctgtgggtgcggtctcccctctccaaatgccacctcttcctgctccctcctcttttggctcctactcagtagttccattgtgggctgcagtaatataaggacctgttctggacacagcactgggcccgctggggttttagtagggcagccccttccctgcaggagtgaggcatggtgacagcagtcccctatgtgcccccaagtcatctgagcattggtgtgcattaaggtactcaatcttccaacaataaataccataagtgca

SEQ ID NO: 138314 - DNA, 6403 bp, Homo sapiens
  Payload ID: 7089
  Gene Symbol: GBF1
  Gene Name: golgi brefeldin A resistant guanine nucleotide exchange factor 1
  Uniprot ID: Q92538
  ENST ID: ENST00000369983
  CDS Start-End: 261-5840
agttaccacgtcagtgagctgacagggaaggtacccggctctactgcccgtcccggacgactcatcctggcggactgtgcagtcccaccctgacttcggcctcaatttccaggaaacaggctccttctcttctcccatctgctaccagagccgggagagctgctcggagacgcctccggggtgcgggctggacatgagcagcggctgccggtcctgggactaggccccgccattttggatccgctgacaggtttgccaagatggtggataagaatatttacatcattcaaggggagattaacattgtggttggggccatcaaacgaaatgcccgatggagcacccatacaccactggatgaagaacgggatcctctgctgcatagtttcggtcatctaaaggaggttttaaacagtataacagaactctcagaaattgagcccaatgtattccttcgaccttttctggaagtgattcgctctgaagataccactggccctatcactggactggcactcacctctgtcaacaagttcctgtcctatgcactcatagatcccacccatgagggcacagcagagggcatggagaacatggcagatgctgtcacccatgctcgttttgtgggcacggatcctgccagtgatgaagttgtcctgatgaaaatccttcaggttctacggactctgctgctaaccccagtgggtgcccacctaaccaatgaatctgtgtgtgagattatgcagtcttgcttccggatctgctttgaaatgaggctcagtgagttattgagaaaatccgcagagcacactctcgtagacatggtgcagctgctcttcacaaggttacctcagtttaaagaagaacccaagaactatgtggggaccaacatgaagaagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatactgagagaactgccagcgatgggaaagctgtaggcatggcctcagacatcccaggcctgcatctgccaggtggagggcggctgccaccagaacatgggaaatcaggatgcagtgatctggaggaagctgttgactctggggctgacaaaaagtttgcccggaagccaccccgattttcctgtctcctgccagatccacgggaactaattgaaattaaaaacaaaaagaagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgagcaccttcagttttcagggtctgcgactggacgaagccctccgcctctacctggaagccttccgtttgcctggggaagcaccagtcatccagaggttgctggaggcattcacagagcgttggatgaattgtaatggctccccatttgccaatagcgatgcctgcttttccctggcctatgctgtcatcatgcttaatactgaccagcacaaccacaatgttcgtaaacagaatgcacccatgaccctggaggagtttcgcaaaaatctgaaaggtgtgaatggaggcaaggactttgagcaagacatcctggaggacatgtaccatgccatcaagaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcattgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacaggtcagtcaggacttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtcttcctgcagcacctgtctccactgctgtcactctctacctttgcggccctctggctcaccatcttggacttcatggacaagtacatgcacgcaggctccagcgacttactgtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgcccccagagattccatctgagctgggggcctgtgactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagcatca

SEQ ID NO: 138315 - DNA, 8261 bp, Homo sapiens
  Payload ID: 7090
  Gene Symbol: GLG1
  Gene Name: golgi glycoprotein 1
  Uniprot ID: Q92896
  ENST ID: ENST00000205061
  CDS Start-End: 21-3632
gagctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttggtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgttttttttctttctgtccatttgctgcgtgtacccactctagtaggcattggctaaatgttgtattttggcgattcatcaacctttgcagaatatgggctttatagaagcaatattcttggccatcccgcctcattcctccagtgtggagatgacaagtctgggtgtgagagggaggggtccgggcatcatggttcagcgtggcactcctttggttgagtttggggcatgagatcacagtggctgcacaagagagcagtgtgtacagtaggagagacatttatgtaatatatattttattaacctgttagatgtccacaaagtattataaatcacgtgcctaaaactgtccatgtagaccaaggcctgccctcggcgccccccactcttgcctctgctctgcacagtccacgtgcactgcaggaccggagcgacacatgtcttccctgaagggtgttcagtacaaggcgtgtcagtttgtggatcagttgatccaagttactccttgtctaacctgactgacatatatttgaatactgtggttttctttcttttttttctatttgctgcccttcctggaggcagtgggttccagaagccaactgattgtccccctgccaagtcaccaagggaagctgctaagctgcttagtcccctcggtcctgcttgtagggtcttcctgattgtcaacagctgtctgggatgcttcagtctcctaaaactggaaacgcagggtgcgagcagcacacactgcctcccgccactgccagccggagtgagcggcccgagagtctctgcaggttcccctgggggctgggggccgctgaggcctaatatcaagagccaggaatgtcatgtacatggaggtgcctacggacgtgcctggtgtggtttgcaggtaggatggatgttcactgtttgaccgggtggggtatccttcctctctgcagtctccttcccagtatgcgtaaacacccttatagttctaattgtgttgatatttctgttctttctgaattgagagaaaatcccattcgttgtctgcagatttggaagtttgatgaggaatttggttcttgaaacatctgtctttttttttttttttgagacagagtatctctctgttgcccaggctgcagtgcagtggcgcgatctcagctccctgcaacctccacctcctgggttcaagcaattctctgcctcagcctcctgagtagctgggattccaggcacccgccaccacgcctggcttatttttgtatttttagtagagatggggtttcaccatcttggccaggctggtcttgaactcctgatctcatgatccacccgcctcagcttcccaaagtgctgggattacaggtgtgagccaccctgcctggccaaaacatttgtcatctttataaatggtcagaatagaaaagttagctctgccagtatcttcaattacttattacaagaatgtctttcatcatcttacttggagcattttccaatgactggctcttgagagccccaggcagggccccgagcaagtttttctaagtgccaaggccagcaaagtctgaactggccgcactcattaagtccctcatttggcaaaacaaaacagggcctggggcacccctggttcctggccttataggtcagtcaactggctgagaaatggtcaagaaaagaaacaatgacccttctgtggatgtgagtggatgatggactctggcctgtgtctactctcctgatgtgtagcccaccaacagtaatagaagtagagggtagggggttttgccaaggctaaggcttcaggtacttgctaacagttatagcagctgggtcactgtcatctggacttaccagttcatgccagtgtccctgtgacttatgcatagtgtgcgccacagccctctagaggtacctggagcccggactgccaggctggaggctctggggtactgaaggtgagctgtctgggcaaactattaagaacaagacgaactgttcacaatggagcttctcccacagatggggagctctgtgaggccttcacctgggtgcatgttggacttccattgctgttgctgttgtccctagacaagcccgttagcaagaagcaccggcaggggagccatgcactccataggcttgggatcacccccgggaaagcgatcttccccgggctaccacccccagctgcagttctgtgttagtgcatccttcaaagctaggagaattctagggtgaccagtgagctaatgttgagtgagcaggtattgacttgaacacactgcaggcctttggctgtctcatgctgtccttactcttcttgggaacagtgagtcactcagctggccagggtggggatgcatcctggtgaagagacagctttccctgaagatgctacagaaagttactgtcagatttcatttgtttctgtttcctgagatcaactaacagaagaatctaatggtgagagtgtcttcattcatgttttacgttttatcaaggcacactggaaagggaattatgtggctgacttcccttggccttcccaagagaagattctgttcttatgtcagtgtggcttctggaagtgtctcctatcctcccatcctccaggcctgtggtgtgacttctgccccgaagttcctactatagtgagtcatctggggagaggccactgaaaagaggccttcccttcccatttcctcccctgcctccttagaacacactctaagtcagaacttaatctaagaagaaggaagctggaccaggaaccttggaagtcagccagccctagaacagtcagcctaaattttggccgtaatggcttttttggttttttgttttgtttctgagatggagtctcactccgttgccaggctggagtgctgtggcgctatctcagcttaccgaatcctccgactccctggttcaagcgattgtcctgcctcagcctccggagtagctgggattacaggcatgcaccaccacacccagctaatttttgtatttttagtagagacggggtttcaccgtgttgtccaggatggtctccatctcctgacctcatgatgtgcccacttcggccttccaaagtggccgcaaagtggcccacttcggccaaagtgcacttcggccttccaaagtgcattacaggcgtgagccaccacgcccggcctggccttttttttttttttcttttgagacacagtttcactcgttgcccaggctggagtgcagtggcgcaatctcggctcactgcaacttctgcctcctaggttcaagcagttctcctgcctcagcctcccaagtagttgggattacgggcatgcaccaccatgcctggataattttttcttatttttagtagagacaggatttcatcatgttggccacgctggtttcgaactcctgaccacatgtggtccacccaccttggcctcaattatgtgcattttggtatatttacttgtatttcaacatcttgtgagtttgaaaaacctgaaaggccagaatgcttccttttatttctcaccatttgggcagcacctaagtggttttgtaaaatgcagcatctggtgctgtgggtctctctcaggccttgagggacacttccttcctccccactcgcctcctctccactagactttggttcctagagggcgtggggccgggtctgaggttcttgcctgccttccctcccattggtctttggttgctcatccctctaactgcaccccttcttggtccttcctccacagacttcagataatagataagtcattagcaaaccagaccgaatctttagggtgaagagctccccaaagccatctggtgaggtcattgtggggaccagggactgattatttgtcacctggatcacaaagatgggactgtctgctcaggctggtggtgacaggatcctgacccgtggtcctctcccgctccctctgctccaccaggacacatgtataggacactgtgctgtgtgcagtggagaaatctccctgggccaggggaaagttcagacagtgcctctagattgtgttttgcctcctccaatgtagagttgacatctggaccccagagcccagcagggctttctgtcagacatgctagggtggtagaaatgggccctccaggtccccctgcagtgcactgggcagagacctccggaaagccggcagcgggagcgcttcctgggcagcttcccccagcacagtgttcccaaaccagtccatccggaaaacagtctgtacagcaaatgctgtgtgagatcttaggcttttcactttttttgttttgttttgtttttgaaagaaagaaaaaaatacaattaacaagcctcttttgtaaatgggtttcctttctatgtataaaatcgtggtggtcccttgtttttacatgttcatgctgtgtaattttgagatgttactgagatatgttctgaacataatgtgcatttttttctgtacagatgaaatgggagaatttaataaagagtttgcaggtttttacttgttaaa

SEQ ID NO: 138316 - DNA, 4748 bp, Homo sapiens
  Payload ID: 7090
  Gene Symbol: GLG1
  Gene Name: golgi glycoprotein 1
  Uniprot ID: Q92896
  ENST ID: ENST00000422840
  CDS Start-End: 1-3540
atggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttggtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcccaggaaccttcctcctccagggcagcacaggactcagccatgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatt

SEQ ID NO: 138317 - DNA, 3626 bp, Homo sapiens
  Payload ID: 7090
  Gene Symbol: GLG1
  Gene Name: golgi glycoprotein 1
  Uniprot ID: Q92896
  ENST ID: ENST00000447066
  CDS Start-End: 19-3597
gctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagttgttgtggaattataagctgaacctaactacagatcccaaatttgaatctgtggccagagaggtttgcaaatctactataacagagattaaagaatgtgctgatgaaccggttggaaaaggttacatggtttcctgcttggtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggctacaatacaggtcagagacaatggcttataaaggtttagtgtggtctcaggatgtgacaggcagtccagcctgacctttctgcacactccagacaaacttccc

SEQ ID NO: 138318 - DNA, 4037 bp, Homo sapiens
  Payload ID: 7090
  Gene Symbol: GLG1
  Gene Name: golgi glycoprotein 1
  ENST ID: ENST00000562090
  CDS Start-End: 12-2108
gcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttggtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggccgaaagggaatatgtctttaaaaatttgcctttcaaagtataacggaggagcagttctatatttattctggggctatctacttcaaatactagaatcgtttccaaaagatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaa

SEQ ID NO: 138319 - DNA, 601 bp, Homo sapiens
  Payload ID: 7090
  Gene Symbol: GLG1
  Gene Name: golgi glycoprotein 1
  ENST ID: ENST00000565474
  CDS Start-End: 380-601
gatgtaggttaaaaggagtggaccagtgttctctttctgacagaaccattaaaattcctaacccacattggactgtcatctttcatccattaagacataatgctgcctatggataaggttggctgtaaaagttttcacaaataaaagtgtgccccattggtgcaccataagaccccttttctgttgttcatagaggcataaacaaggaaaacattgagagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttggtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggc

SEQ ID NO: 138320 - DNA, 2918 bp, Homo sapiens
  Payload ID: 7090
  Gene Symbol: GLG1
  Gene Name: golgi glycoprotein 1
  ENST ID: ENST00000567951
  CDS Start-End: 5-922
caagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttggtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaa

SEQ ID NO: 138321 - DNA, 461 bp, Homo sapiens
  Payload ID: 7090
  Gene Symbol: GLG1
  Gene Name: golgi glycoprotein 1
  ENST ID: ENST00000565260
  CDS Start-End: 4-461
aagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatg

SEQ ID NO: 138322 - DNA, 2147 bp, Homo sapiens
  Payload ID: 7090
  Gene Symbol: GLG1
  Gene Name: golgi glycoprotein 1
  ENST ID: ENST00000627032
  CDS Start-End: 51-2147
atttaaatacgcggcgccggcgagtgcgtcgagctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttggtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggccgaaagggaatatgtctttaaaaatttgcctttcaaagtataa

SEQ ID NO: 138323 - DNA, 2100 bp, Homo sapiens
  Payload ID: 7091
  Gene Symbol: GOLIM4
  Gene Name: golgi integral membrane protein 4
  ENST ID: ENST00000309027
  CDS Start-End: 60-2066
gctcggaccaaggggaggagacggcgggggcggccgcggctttgggtccaggcgggactatgggaaacgggatgtgctcccgaaagcagaagcggattttccagacgctgctgctgctgaccgtcgtgttcggctttctctacggcgcgatgctctactacgagctgcagacgcagctgcggaaagccgaggcggtggcgctcaagtaccagcagcaccaggagtccctctccgcccagttacaagttgtatatgaacacagatcaagattagagaaatccttgcaaaaagaaagacttgaacataaaaaagcaaaggaagattttcttgtttataagttagaagcacaagaaacattaaataaaggaaggcaagattccaatagcagatacagtgcactgaatgtccaacatcagatgttgaaaagccaacacgaggagctaaagaaacagcacagtgacttggaagaggaacatcgcaaacaaggggaagacttcagtagaacatttaatgaccataagcaaaaatacttgcagctccagcaagaaaaagaacaagaactttctaagctaaaagagactgtatacaatttgagagaagagaatagacaactaaggaaagcacaccaagacatacatacacagcttcaagatgtcaagactcaagttgcagaatataaacaactgaaagatactctgaataggattccaagccttcgaaaacctgatccagcagaacagcaaaatgtgacccaggtggcacattctccacaaggttacaacacagcaagggagaagccaacccgagaggtgcaggaggtgtctcgaaataatgatgtgtggcagaaccatgaagcagttcctggaagagcagaagacacaaaactctatgctcccacccataaggaggcagaatttcaggctcccccagagccaatccaacaagaagtggaacgcagagaacctgaggagcatcaggtggaagaggagcacagaaaggccctggaggaggaagaaatggagcaggtcgggcaagcagaacatcttgaggaggaacacgatccatcaccagaggagcaggatcgggagtggaaagagcagcatgagcaacgagaagcagccaacctcctggaagggcacgcgcgtgctgaggtgtacccttcagccaagccaatgatcaaattccaatcaccctatgaggaacagttggaacagcagagactggcagtgcagcaggtggaggaggcccagcagctgcgggaacaccaggaagctttgcaccagcagaggctgcaggggcacttactacggcagcaggaacagcagcagcagcaggtggcaagagagatggccctgcagaggcaggctgagcttgaggagggccggccgcagcaccaggagcagctccggcagcaagctcattatgatgctatggataatgatatcgttcagggagcagaggaccagggaatccaaggagaggaaggagcctatgaaagagacaaccagcaccaagatgaagcagaaggagatccaggtaatagacatgagcctcgtgaacaaggaccccgagaagccgacccagaatctgaggcagatagggcagctgtagaagatataaacccagcagatgaccctaataatcaaggtgaggatgaatttgaagaagccgagcaagtgagagaagaaaatttgccagatgaaaatgaagagcaaaaacaaagtaatcaaaagcaagagaatacagaagtggaggaacatttggtgatggcaggaaatccagaccagcaggaggacaatgttgatgaacagtaccaggaagaggcagaagaggaggttcaggaagatttgactgaagagaaaaaaagggaactggagcataatgctgaagagacctatggtgaaaatgatgaaaatactgatgataaaaataatgatggagaagagcaagaagttcgagatgacaaccgccccaaaggccgagaggaacactacgaggaggaagaagaggaggaagaagacggggctgcagttgctgagaaatcacatcgaagagctgaaatgtagcggcacccaatttctagacaacgctcagccaacg

SEQ ID NO: 138324 - DNA, 4373 bp, Homo sapiens
  Payload ID: 7091
  Gene Symbol: GOLIM4
  Gene Name: golgi integral membrane protein 4
  Uniprot ID: O00461
  ENST ID: ENST00000470487
  CDS Start-End: 691-2781
aatgagcaaggaggccgagtgggacttcctcccggaatcccgttggccagaatagccgggccgtgggtgacacgtaagttgggcaggaggtggcggggcggcagaggcaccagccgacccgtcagtgacaccgctgtgccgtccccaaaaccagccgagacagctggcccccacccttccacccattgggcaggccgcacgggggcgcggcccggagtcctggtccctttgttgggcgcgcaccccctcccttaggtggcaacaaagtcgtgcagtgggagccgccgcgatagggcggggagtggccagggcgggactccaagaactgcccgggggcagcggggccaaaaagtgggaagaaggaaaaaaggcaggaggcatctggggacaggcgcgagggcagccggctctgaagtatgcggagggcctcctcccggccccgggcattcgcggagaacgagcctcgcagaagtttggctgcagctgcccgggcggcgtcgatggctgcgcgccccgcgccgcgcgggggctgagcgggcgccacttcccctccgggccggcttttgtgtctggcatctcctcctcatgctgcgtctggccacctactgcggcggccgctgctgagacgctcgctcggaccaaggggaggagacggcgggggcggccgcggctttgggtccaggcgggactatgggaaacgggatgtgctcccgaaagcagaagcggattttccagacgctgctgctgctgaccgtcgtgttcggctttctctacggcgcgatgctctactacgagctgcagacgcagctgcggaaagccgaggcggtggcgctcaagtaccagcagcaccaggagtccctctccgcccagttacaagttgtatatgaacacagatcaagattagagaaatccttgcaaaaagaaagacttgaacataaaaaagcaaaggaagattttcttgtttataagttagaagcacaagaaacattaaataaaggaaggcaagattccaatagcagatacagtgcactgaatgtccaacatcagatgttgaaaagccaacacgaggagctaaagaaacagcacagtgacttggaagaggaacatcgcaaacaaggggaagacttcagtagaacatttaatgaccataagcaaaaatacttgcagctccagcaagaaaaagaacaagaactttctaagctaaaagagactgtatacaatttgagagaagagaatagacaactaaggaaagcacaccaagacatacatacacagcttcaagatgtcaagcaacagcataagaatttactctccgagcatgaacaacttgtagtgactttggaagaccacaagagtgcactagctgctgcacagactcaagttgcagaatataaacaactgaaagatactctgaataggattccaagccttcgaaaacctgatccagcagaacagcaaaatgtgacccaggtggcacattctccacaaggttacaacacagcaagggagaagccaacccgagaggtgcaggaggtgtctcgaaataatgatgtgtggcagaaccatgaagcagttcctggaagagcagaagacacaaaactctatgctcccacccataaggaggcagaatttcaggctcccccagagccaatccaacaagaagtggaacgcagagaacctgaggagcatcaggtggaagaggagcacagaaaggccctggaggaggaagaaatggagcaggtcgggcaagcagaacatcttgaggaggaacacgatccatcaccagaggagcaggatcgggagtggaaagagcagcatgagcaacgagaagcagccaacctcctggaagggcacgcgcgtgctgaggtgtacccttcagccaagccaatgatcaaattccaatcaccctatgaggaacagttggaacagcagagactggcagtgcagcaggtggaggaggcccagcagctgcgggaacaccaggaagctttgcaccagcagaggctgcaggggcacttactacggcagcaggaacagcagcagcagcaggtggcaagagagatggccctgcagaggcaggctgagcttgaggagggccggccgcagcaccaggagcagctccggcagcaagctcattatgatgctatggataatgatatcgttcagggagcagaggaccagggaatccaaggagaggaaggagcctatgaaagagacaaccagcaccaagatgaagcagaaggagatccaggtaatagacatgagcctcgtgaacaaggaccccgagaagccgacccagaatctgaggcagatagggcagctgtagaagatataaacccagcagatgaccctaataatcaaggtgaggatgaatttgaagaagccgagcaagtgagagaagaaaatttgccagatgaaaatgaagagcaaaaacaaagtaatcaaaagcaagagaatacagaagtggaggaacatttggtgatggcaggaaatccagaccagcaggaggacaatgttgatgaacagtaccaggaagaggcagaagaggaggttcaggaagatttgactgaagagaaaaaaagggaactggagcataatgctgaagagacctatggtgaaaatgatgaaaatactgatgataaaaataatgatggagaagagcaagaagttcgagatgacaaccgccccaaaggccgagaggaacactacgaggaggaagaagaggaggaagaagacggggctgcagttgctgagaaatcacatcgaagagctgaaatgtagcggcacccaatttctagacaacgctcagccaacggattcttttcaagctgctcaaacataaatctgcctactgaactctaggatatttaattacaaaaattaagaacttagacttttttaaaacttttgtattagaaatgcgcatacatttatatgaatatattttgataacgtaggtctagagcttcttttatattcaagctaaacatgaaaaagaagaaaaacaataaagtaaacctgagcccccacgtcccaatttttttaatagattatgtgatgttggaaagctcattgattttgtatatgtttcagcgtgttacctttctggcttccagttcccaggtgttctttgtttgcctttgataaaatacaggatttaagaacagagagtactgcaaaatgccatgcagactttaaagagaatggcctgtttactaattgctgcccttctgatgtctttatgtatagctctgatagaattttcaccagtctatgtatctctggagtgagatctatgtacaaagtgacatacaattggaaatccatttttgttgtaaagacattgtttttcagacttttcagatcaattagaaaaatgtcattgctttaaaatcatagctgttctgtttaagaggaattgaatttaaaaatgagagagtattaaaactcatgtggcagtatcctggtcttaatcaggtattgcagtgttcaaacaaggtatggacacatcaacatattcaccttttggaaggactagtgacttggttaaaaactaatgagtgtttgcgtgtggtgtttctatgcgagcacccattctcaattttttttttttttttttgtttgaagccattgattgatattcttgtttcagtgtctggttccctataagtaatatatatttcctctttaagctctgtgcctcaatatgcaatcactttgataataagtataaatatgaagacataccaaactgcaaataggattatttttcaaaactatatggtgaaacatatggtgatatgatagacttatggtttttctgtttgctgggattgggtctgctttttgcctatgtgtaaggcattttaatcattgtgaatataatagattccttaaaataagaaaattaaaaatcagaaacttcccttggagtagagacatttcagttgcaagcataaagatttttaaatatataacactaggttatataattcatatatgtgtggttttgtattaataatcaaattaataaaaacatttcattttctaccattgtatgaacgtaattttattttttaataaccacactcatagatggttttgattgttccagttgagtgattgtgtatgtacgcataggaatgttttgttcagttgtactttgtatttccaataatcagaaatcttacctttatgtataaaaacccattatgtaatgtaaaatgtataatattgtacataatattcagaatacaattattttggtaaattagcttgtatttttaatgtcccagttgcagtatttaattatttgaaccatactgaaagttggtaatagtcaataaagctaaaaaaaaaaagtggcaaatctt

SEQ ID NO: 138325 - DNA, 3022 bp, Homo sapiens
  Payload ID: 7092
  Gene Symbol: GOLM1
  Gene Name: golgi membrane protein 1
  Uniprot ID: Q8NBJ4
  ENST ID: ENST00000388711
  CDS Start-End: 147-1352
atcttcactttttccgttgctagcagtggaagggtcacagaccaaacactaaggcctgagcggtgacaaccgaggcgagatgatggtcaacagggaatgcctcgtgggagaaaaaagacaattttattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaactt

SEQ ID NO: 138326 - DNA, 3046 bp, Homo sapiens
  Payload ID: 7092
  Gene Symbol: GOLM1
  Gene Name: golgi membrane protein 1
  Uniprot ID: Q8NBJ4
  ENST ID: ENST00000388712
  CDS Start-End: 170-1375
ggagacgcggcggcgctggacgcggaggcgctgggcgcacggcgcggagccggccggagctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaactta

SEQ ID NO: 138327 - DNA, 561 bp, Homo sapiens
  Payload ID: 7092
  Gene Symbol: GOLM1
  Gene Name: golgi membrane protein 1
  ENST ID: ENST00000470762
  CDS Start-End: 22-339
attctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagc

SEQ ID NO: 138328 - DNA, 506 bp, Homo sapiens
  Payload ID: 7092
  Gene Symbol: GOLM1
  Gene Name: golgi membrane protein 1
  ENST ID: ENST00000466178
  CDS Start-End: 267-506
atcttcactttttccgttgctagcagtggaagggtcacagaccaaacactaaggcctgagcggtgacaaccgaggcgagatgatggtcaacagggaatgcctcgtgggagaaaaaagacaattttagtctcactctgttgcccccaggctggagtgcagtggcgcgatctcgactcactgcaacctctgcctcccgggttcaagtgattcttctgcctcagcctcccgagtagctaggactacagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcag

SEQ ID NO: 138329 - DNA, 869 bp, Homo sapiens
  Payload ID: 7092
  Gene Symbol: GOLM1
  Gene Name: golgi membrane protein 1
  ENST ID: ENST00000486130
  CDS Start-End: 506-869
acagatacggtccctaaagtgagaaatgaatgttcgaaagaaggtgctctcgtttggcatggagtgaatgccttgtttccacctcaaatcctaagatggaacacatttttcctggtgacttcaggcagatggcacacctcccacttccgttgtgtgtcatgaaggaggagacacttctatagccagggctgtgcctgaataatgatgtacatgggggggagttcacattcacctccagaatgggtttcctgctttgcttgagaaatgctttaattgggtgtcattagtaatcctgtcaagggtaaaaaaaacctcccttgttaggaatcaaagcaaaaagctctctctgaggagtaatgaggaatatactctttctaatatgatgcggaagcacttaatatttgttattggtgtttacagaaatgattacttctcaaacattgctgcttacagaaatgattaattctcaaactatgccgggaagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaag

SEQ ID NO: 138330 - DNA, 2721 bp, Homo sapiens
  Payload ID: 7093
  Gene Symbol: GOLPH3
  Gene Name: golgi phosphoprotein 3 (coat-protein)
  Uniprot ID: Q9H4A6
  ENST ID: ENST00000265070
  CDS Start-End: 317-1213
acatcctccggtgacgtcagccggggccgccatattggaaaggcgccgccgccgcctccgccttggagctcggggtgtttcggggactgcggccacaggcaggaaggcgctcctctcctgccccgccgacgcccggccagcccgcttcgccctgacctgtttcctcatgactgcccccggccctgctgccgacggacgtcgccccggcgtccggatttaacacggaaacccggatcggaggccgcgcggggaggaggagggcgacccggtcggtcctgcgaccctctcggcccggctcggcgcctcggcgggagccatgacctcgctgacccagcgcagctccggcctggtgcagcggcgcaccgaggcctcccgcaacgccgccgacaaggagcgggcggcgggcggcggcgccggcagcagcgaggacgacgcgcagagccgccgcgacgagcaggacgacgacgacaagggcgactccaaggaaacgcggctgaccctgatggaggaagtgctcctgctgggcctcaaggaccgcgagggttacacatcattttggaatgactgtatatcatctggattacgtggctgtatgttaattgaattagcattgagaggaaggttacaactagaggcttgtggaatgagacgtaaaagtctattaacaagaaaggtaatctgtaagtcagatgctccaacaggggatgttcttcttgatgaagctctgaagcatgttaaggaaactcagcctccagaaacggtccagaactggattgaattacttagtggtgagacatggaatccattaaaattgcattatcagttaagaaatgtacgggaacgattagctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttctcgacttagaccctgaagtggaatgtctgaaggccaacaccaatgaggttctgtgggcggtggtggcggcgttcaccaagtaactctgctcggggtgaaccattctcctttctctcaagtaaaccagtagtttttcttctgttgacttctggttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatccccttgttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttgaaagtgcctgaatcagagcaagca

SEQ ID NO: 138331 - DNA, 1074 bp, Homo sapiens
  Payload ID: 7093
  Gene Symbol: GOLPH3
  Gene Name: golgi phosphoprotein 3 (coat-protein)
  ENST ID: ENST00000503610
  CDS Start-End: 269-550
ccgccgcctccgccttggagctcggggtgtttcggggactgcggccacaggcaggaaggcgctcctctcctgccccgccgacgcccggccagcccgcttcgccctgacctgtttcctcatgactgcccccggccctgctgccgacggacgtcgccccggcgtccggatttaacacggaaacccggatcggaggccgcgcggggaggaggagggcgacccggtcggtcctgcgaccctctcggcccggctcggcgcctcggcgggagccatgacctcgctgacccagcgcagctccggcctggtgcagcggcgcaccgaggcctcccgcaacgccgccgacaaggagcgggcggcgggcggcggcgccggcagcagcgaggacgacgcgcagagccgccgcgacgagcaggacgacgacgacaagggcgactccaaggaaacgcggctgaccctgatggaggaagtgctcctgctgggcctcaaggaccgcgaggtgcgggcgcggcgggctgggcggggggcggcggcgcggggcccgggcgccaggtgagctccagggttacacatcattttggaatgactgtatatcatctggattacgtggctgtatgttaattgaattagcattgagaggaaggttacaactagaggcttgtggaatgagacgtaaaagtctattaacaagaaaggtaatctgtaagtcagatgctccaacaggggatgttcttcttgatgaagctctgaagcatgttaaggaaactcagcctccagaaacggtccagaactggattgaattacttagtggtgagacatggaatccattaaaattgcattatcagttaagaaatgtacgggaacgattagctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacg

SEQ ID NO: 138332 - DNA, 2999 bp, Homo sapiens
  Payload ID: 7094
  Gene Symbol: GOLPH3L
  Gene Name: golgi phosphoprotein 3-like
  Uniprot ID: Q9H4A5
  ENST ID: ENST00000271732
  CDS Start-End: 46-903
ctgcgtccagccataacccaggagtaacatcagaaacaggtgagaatgaccactttaactcaccgggcccgtcgcactgaaataagcaagaactctgaaaagaagatggaaagtgaggaagacagtaattgggagaaaagtccagacaatgaagattctggagactctaaggatatccgccttactcttatggaagaagtattgcttctgggactaaaagataaagaggggtacacatctttctggaatgactgcatatcatcaggcctgcgagggggcatcctgatagagctggccatgcggggtcgaatctatctggaacccccgaccatgcgtaagaagcgactactagacagaaaggtactgctaaagtcagacagcccaacaggtgatgttttactggatgaaactctgaaacacatcaaagcaactgaacccacagaaactgtccaaacatggatagagctactcactggtgagacctggaaccccttcaaattacagtaccagctgagaaatgtacgagagcgcatcgcaaagaacctagtagagaaaggtattctaaccactgagaagcagaatttcctgctatttgacatgactactcatccagtgaccaatacaacagagaaacagcgactagtgaaaaaacttcaagatagtgtactagagcggtgggtaaatgaccctcagcgtatggacaagcgaacactagcactcctggtgctagcccactcctctgatgtgctagagaatgtcttctcctctctgacagatgacaagtatgatgtggcaatgaatcgagccaaggacttagtagaactggaccctgaagtggaagggacaaagcctagtgccacagaaatgatctgggctgtgctggcagccttcaataaatcttaaagccggcaggtggatttctccttttcccctgctggctggtgactgtcagagaccccatcactgagttttgtgtgatgagatgttttcatcatttttgtttccttttcttgaatcagacttgtgatttggggagagcaacttcagggcttctccatagaccttgaccattataagcagaccttatttctccctacacttccactccataggtaaataaactgggtgaagccacacacacccaatgaacattttctcccatttggtggtttagtttcacccagtgtgcttttggataagcagaaatatctaaatgggattttgagttctccagctatagaatgtgaatgagataaaaagtgaactatctattatatttttctgagtttgttttctatcataaatacatgttttcacagcctttgtctctcagactctgctaaataatgtagcttattgaaataactgtcgctgaataaggagcaatgagaaacaaaactaatttttggagcagatggtctctggaattgcatatcctgctagtgattttctcatctttccttttctaacctaatgagaatgtcccagattcaattacctggatgtcaaagtcctagagccagaaatatattctctcatccctcttagcattctcttgctccctcattcactagggcaaatgtctaaatgaagaaaagtctctctcaacacctcgttcatgcaatcagcattagaatttgtaaggaaggaaggggggtggcatgaaaatttccattcttggggtatatgactgtcctgtttcccccaggccactttttttttttttttcttttgagacagggtcttgctcttgcccaggcaggagtacagtagtgcaatcacagctgactgcagccttgacctccagggctcaaggatcctcctgcctcagtctcccaactaagtgggactacaggcacgtgccaccatactcagcttttttttgtttgttttagacaagagtctcgctttgttgcccaggctggtcttgaattcctgggctcaagcaattcttccacctcagcctcccaaagtgctgagattactggcttgagccactgcacccacccctccagactactttaaatgtctctgctctgactgaattgaaggaattgtaagtttcagttgctgaatatatcagtatatctgaactccagatctttttatttcctatttttggcttcctacataaattaataaagtctgtctatatttaaggtttctgggagtagttttgtctatatttaatccatagatgtgctcctagtcatcagtcttatttcagtaaaaccatctttctggccaaatctctaacacgttttttacttcagtagtgagggcaatgagaagctttattaagaaagatcctatttaaagggctaatttggtattgaaagcatgctgatataaagtccagtatttgaggatataaagaggatgtgcactgagctgtgctgatgttcagcatttattatactttaatgggatagtgcttcttgaccattatagaacaacaaactgtcaaagggttaatacagatgacccagacctgacattaaatcctcttgattagaaataattaaatgaattatttattcatttctctcctctgccaaatctacttagccccacaaaaatgccccagctcagttaacatttttttgtttttcactttaggtatctcttaggcaaatagagatataaattgtaataggaaacagtctctaaatgtgaggctgaatacagcttcagtctggctctctaataggacaaaagccagtccatgtgttgtctctaactgatttagctttttcttttctttgaacaattcggcatgaattgaaaccaggttttcctgtggaaagttatagcttgattgggagatagaagttgaattgagttctttcttgcaactcttagtgtttatttttatatctcagtaagacgaggataccttcagtttgaatctgcataatgttcactgccaaactccttctcatttaatgcttatggccttcacatttctgtataataaagatcaattatcagctctctgg

SEQ ID NO: 138333 - DNA, 973 bp, Homo sapiens
  Payload ID: 7094
  Gene Symbol: GOLPH3L
  Gene Name: golgi phosphoprotein 3-like
  ENST ID: ENST00000427665
  CDS Start-End: 166-973
ttctctgcatcgaaggatcaggaagtttgtgctctctgcgtggctaagtttttcacctactaggacgggggtggggtggggagaacaggtgtccttctaaaatacagcacaagctacagcctgcgtccagccataacccaggagtaacatcagaaacaggtgagaatgaccactttaactcaccgggcccgtcgcactgaaataagcaagaactctgaaaagaagatggaaagtgaggaagacagtaattgggagaaaagtccagacaatgaagattctggagactctaaggatatccgccttactcttatggaagaagtattgcttctgggactaaaagataaagaggcaaatatcaacagttggattacgcggtggctcacgcctgtaatcccagcactttggggagccgaggggtacacatctttctggaatgactgcatatcatcaggcctgcgagggggcatcctgatagagctggccatgcggggtcgaatctatctggaacccccgaccatgcgtaagaagcgactactagacagaaaggtactgctaaagtcagacagcccaacaggtgatgttttactggatgaaactctgaaacacatcaaagcaactgaacccacagaaactgtccaaacatggatagagctactcactggtgagacctggaaccccttcaaattacagtaccagctgagaaatgtacgagagcgcatcgcaaagaacctagtagagaaaggtattctaaccactgagaagcagaatttcctgctatttgacatgactactcatccagtgaccaatacaacagagaaacagcgactagtgaaaaaacttcaagatagtgtactagagcggtgggtaaatgaccctcagcgtatggacaagcgaacactagcactcctggtgctagcccactcctctgatgtgctagagaatgtcttctcctctctgacagatgacaagtatg

SEQ ID NO: 138334 - DNA, 3722 bp, Homo sapiens
  Payload ID: 7095
  Gene Symbol: GORASP1
  Gene Name: golgi reassembly stacking protein 1, 65kDa
  Uniprot ID: Q9BQQ3
  ENST ID: ENST00000319283
  CDS Start-End: 823-2145
agatgggagggaggctgttgcaggctctcaggggggagagatggtgctggttctgggctagaagataaaaagataaaaagaaaacccaggagacatcaaggagctggcatttcttgtagacaggattagaagatgagtatagggaagaggtatgagttaaggctaggagattaaatggtgaagccatcaactggggtgggaggcgcaggcgagagtgagctgggtggaagaagggatgatgacaagaagggataatgatagtgattggatgagctggtttggggtagctcaagaaacggggatgctaatttggggctcagggtgcgcagaagccaccggagaagacgcccttgccagggggagtggggcaagaaaaggcaggaccgcctgatataactgaggacagcgaagggtggcaggagagtagcagggcagacggtctctgggtcaggggcggggagtcacgagggagccctcggacagcgcccgggccacgcaccataagggaggagtcattgctgctcatctcgggccgctcgcggctccgagtccgggtctggtggggcggtgcagagcgggattcccgaggcagggtcgtgggcactctatcgcggcgggcggttgaaggcgttacagtccttggaaaccgagctgctagccggttgctaggagcgtccagtgtctggagtgggaggaacaaaacgcctcacgtcacaaggcgcaggaatcgagcgccgagagagcgagtcggtgctactggcgtcgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatatttt

SEQ ID NO: 138335 - DNA, 2873 bp, Homo sapiens
  Payload ID: 7095
  Gene Symbol: GORASP1
  Gene Name: golgi reassembly stacking protein 1, 65kDa
  ENST ID: ENST00000453680
  CDS Start-End: 29-979
gacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaa

SEQ ID NO: 138336 - DNA, 587 bp, Homo sapiens
  Payload ID: 7095
  Gene Symbol: GORASP1
  Gene Name: golgi reassembly stacking protein 1, 65kDa
  ENST ID: ENST00000437458
  CDS Start-End: 7-587
tgaagaatgcaccactaccagtcgggacgcactcgtgcacttagcacacatttacgctcgcctgccgcgggccgctctccgtgctgggcctgggaagagagtcagccacgccgaggacagtcccgggggccggggttaaccgagtggacgcagctgcgggggagcccgtcggcgcgcgtcctgccagtcgtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcga

SEQ ID NO: 138337 - DNA, 814 bp, Homo sapiens
  Payload ID: 7095
  Gene Symbol: GORASP1
  Gene Name: golgi reassembly stacking protein 1, 65kDa
  ENST ID: ENST00000419156
  CDS Start-End: 1-426
tactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggagtctttagccacatgcctgcagcagaagcagcaatgtagtgggtgctcctgtagccaaggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccc

SEQ ID NO: 138338 - DNA, 2523 bp, Homo sapiens
  Payload ID: 7095
  Gene Symbol: GORASP1
  Gene Name: golgi reassembly stacking protein 1, 65kDa
  ENST ID: ENST00000422110
  CDS Start-End: 98-955
aatcgagcgccgagagagcgagtcggtgctactggcgtcgggtcggtccgggtaggcgcagcgggactggacctgggtgccgagcggagccgctgccatgggcctgggcgtcagcgctgagcagcccgcaggcggcgccgagggcttccacctccacggggatgtggaaccatcttcacctgctgcccttgccggcctgcgcccctacacagactatgtggttggttcggaccagattctccaggagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttg

SEQ ID NO: 138339 - DNA, 2933 bp, Homo sapiens
  Payload ID: 7095
  Gene Symbol: GORASP1
  Gene Name: golgi reassembly stacking protein 1, 65kDa
  Uniprot ID: Q9BQQ3
  ENST ID: ENST00000452389
  CDS Start-End: 81-728
gcgagtcggtgctactggcgtcgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaa

SEQ ID NO: 138340 - DNA, 2346 bp, Homo sapiens
  Payload ID: 7095
  Gene Symbol: GORASP1
  Gene Name: golgi reassembly stacking protein 1, 65kDa
  Uniprot ID: Q9BQQ3
  ENST ID: ENST00000431601
  CDS Start-End: 506-1246
cggtgggagcctcctgggagaggcggcctcgcgggactcccggaccctggctagtccgcggccgcggtcgggcccagcgcccgccccaagtgccagcagtgccggaagcggagcgttttcctggtccggccgccgggaatggcgctcctcccgggtgaagaatgcaccactaccagtcgggacgcactcgtgcacttagcacacatttacgctcgcctgccgcgggccgctctccgtgctgggcctgggaagagagtcagccacgccgaggacagtcccgggggccggggttaaccgagtggacgcagctgcgggggagcccgtcggcgcgcgtcctgccagtcgtagggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacg

SEQ ID NO: 138341 - DNA, 537 bp, Homo sapiens
  Payload ID: 7095
  Gene Symbol: GORASP1
  Gene Name: golgi reassembly stacking protein 1, 65kDa
  ENST ID: ENST00000416741
  CDS Start-End: 329-537
tagcacacatttacgctcgcctgccgcgggccgctctccgtgctgggcctgggaagagagtcagccacgccgaggacagtcccgggggccggggttaaccgagtggacgcagctgcgggggagcccgtcggcgcgcgtcctgccagtcgtagggtcgtaagggcttccgagggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattct

SEQ ID NO: 138342 - DNA, 588 bp, Homo sapiens
  Payload ID: 7095
  Gene Symbol: GORASP1
  Gene Name: golgi reassembly stacking protein 1, 65kDa
  ENST ID: ENST00000441081
  CDS Start-End: 323-588
ataagggaggagtcattgctgctcatctcgggccgctcgcggctccgagtccgggtctggtggggcggtgcagagcgggattcccgaggcagggtcgtgggcactctatcgcggcgggcggttgaaggcgttacagtccttggaaaccgagctgctagccggttgctaggagcgtccagtgtctggagtgggaggaacaaaacgcctcacgtcacaaggcgcaggaatcgagcgccgagagagcgagtcggtgctactggcgtcgggtcggtccgggtaggcgcagcgggactggacctgggtgccgagcggagccgctgccatgggcctgggcgtcagcgctgagcagcccgcaggcggcgccgagggcttccacctccacggggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtgggg

SEQ ID NO: 138343 - DNA, 1345 bp, Homo sapiens
  Payload ID: 7095
  Gene Symbol: GORASP1
  Gene Name: golgi reassembly stacking protein 1, 65kDa
  ENST ID: ENST00000479927
  CDS Start-End: 100-1137
ggaatcgagcgccgagagagcgagtcggtgctactggcgtcgggtcggtccgggtaggcgcagcgggactggacctgggtgccgagcggagccgctgccatgggcctgggcgtcagcgctgagcagcccgcaggcggcgccgagggcttccacctccacggggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtca

SEQ ID NO: 138344 - DNA, 3173 bp, Homo sapiens
  Payload ID: 7096
  Gene Symbol: GORASP2
  Gene Name: golgi reassembly stacking protein 2, 55kDa
  Uniprot ID: Q9H8Y8
  ENST ID: ENST00000234160
  CDS Start-End: 816-2174
aataagcatgaatacgacctggctacctgaaggaggtaggacggggaaccgagcagcagcaggtggtggaatgccagggaaatccaaccgtgcttcccacgctggcatcgctctgattatgaccaatcctctaatcttattctcacaattagggaggaagaaaaaaaaacaaacccaaaccaaaaaagaagttggtaggtgactctgtgagactactgttttataaagggagcgtttccttttataaaatttagctgagcagatgctaggcagcccacaggaggccactattcccctcagctgtacagtttgggaaaatacctacacacccggagaacagagagcttggtgtgtgttgagttcgctcctgttcatcagcagccctttccccgcctctggccaccagggggacctgcaaccaagtatgtgttctttcaggcgagcgggaacgcgtctgcataaatctagtccaatccagggccccgtagcaaggcgccaaagctgggggaagcgcatttctgttctctcgcgagcacgacgcggtgcctcccagtcctcctccggccctccctctccgccctcccggcccgcgagcgctcgggccccttccagtggctcgcggcaggtggcgctgtctgcggcgtcgcagcggcccgggctgcagcagagacgatctcccggcgggctgtgcggcccggctctccggcggcagcgagtgccacgtcccaagtgctacgcggaggattagagcaggcggtgcgctgggggcgggagcagcgcggagcccggctcggccacaccgatcgcccgccgccatgggctcctcgcaaagcgtcgagatcccgggcgggggcaccgagggctaccacgttctgcgggtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctccgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataag

SEQ ID NO: 138345 - DNA, 624 bp, Homo sapiens
  Payload ID: 7096
  Gene Symbol: GORASP2
  Gene Name: golgi reassembly stacking protein 2, 55kDa
  ENST ID: ENST00000454751
  CDS Start-End: 75-296
ggattagagcaggcggtgcgctgggggcgggagcagcgcggagcccggctcggccacaccgatcgcccgccgccatgggctcctcgcaaagcgtcgagatcccgggcgggggcaccgagggctaccacgttctgcggcttccaaagttaggaagggcgcggaggcaacgtctccaaagtggtgactgtgaaggcagcctttgcgctttcctaggagagggatccggacccgcagtccggaggcggggcctgcggcggcaggtgttaaatcacctcggcgccggccgagtggcctgaaagaccagcagggcaggagacggaaaaccaaatggcctggaagtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctgg

SEQ ID NO: 138346 - DNA, 1976 bp, Homo sapiens
  Payload ID: 7096
  Gene Symbol: GORASP2
  Gene Name: golgi reassembly stacking protein 2, 55kDa
  ENST ID: ENST00000442798
  CDS Start-End: 21-92
cacaccgatcgcccgccgccatgggctcctcgcaaagcgtcgagatcccgggcgggggcaccgagggctaccacgttctgcggcatcaatgagagaaggctcaagcacattgtcagaaataaggaagcttaagccgggcataatggtgtgcacctgtaatcccagctactccaatcaggagactgaggtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctccgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaa

SEQ ID NO: 138347 - DNA, 530 bp, Homo sapiens
  Payload ID: 7096
  Gene Symbol: GORASP2
  Gene Name: golgi reassembly stacking protein 2, 55kDa
  ENST ID: ENST00000455067
  CDS Start-End: 85-201
gctacgcggaggattagagcaggcggtgcgctgggggcgggagcagcgcggagcccggctcggccacaccgatcgcccgccgccatgggctcctcgcaaagcgtcgagatcccgggcgggggcaccgagggctaccacgttctgcgggagagggatccggacccgcagtccggaggcggggcctgcggcggcaggtgttaaatcacctcggcgccggccgagtggcctgaaagaccagcagggcaggagacggaaaaccaaatggcctggaagtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggg

SEQ ID NO: 138348 - DNA, 568 bp, Homo sapiens
  Payload ID: 7096
  Gene Symbol: GORASP2
  Gene Name: golgi reassembly stacking protein 2, 55kDa
  ENST ID: ENST00000444801
  CDS Start-End: 145-243
gatctcccggcgggctgtgcggcccggctctccggcggcagcgagtgccacgtcccaagtgctacgcggaggattagagcaggcggtgcgctgggggcgggagcagcgcggagcccggctcggccacaccgatcgcccgccgccatgggctcctcgcaaagcgtcgagatcccgggcgggggcaccgagggctaccacgttctgcgggtacaagaaaattccccaggacacagagctgaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagca

SEQ ID NO: 138349 - DNA, 6039 bp, Homo sapiens
  Payload ID: 7097
  Gene Symbol: GOSR1
  Gene Name: golgi SNAP receptor complex member 1
  Uniprot ID: O95249
  ENST ID: ENST00000225724
  CDS Start-End: 73-825
acacgcaccatggtgactttccggcctgcatcgcctctgctcccctatcccggctgacgttggacgacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacaggtatagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaaagtgggtctggagtaaacaacagaagaactgagctatttttgaaagaacatgaccaccttcgaaactcagatcgtctgatagaagagacaataagcattgctatggcaacaaaagaaaatatgacttcacagagaggaatgttgaagtcaattcacagcaaaatgaacactttggccaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaattaaaaaaaaaaaaaaaaggttttcagttgcttttgtctccctaggaggcaggtaaaccaatcaaaaacagagttttctgtgtttccatgatagtgttgaagcctaatgacaagccaggtcttacagctgggctcttcagaaaaccaggtttctacatccaaagactgcttttcttttagctgccagattggattgtgaataaaaataattcttccctctccctctccctctccccacggtctccctctttccacggtctccctctgatgccgagccgaagctggactgtactgctgccatctcggctcactgcaacctccctgcctgattctcctgcctcagcctgccgagtgcctgcaattgcaggcgagcgccgccacgcctgactgcctcggcctcccgaggtgccgggattgcagacggagtctcgttcactcagtgctcaatggtgcccaggctggagtgcagtggcgtgatctcggctcactacaacctccacctcccagccacctgccttggcctcccaaagtgccgagattgcagcctctgcccggccgccaccccgtctggaaagtgaggagcgcctctgcccggccgccatcccatctaggaagtgaggagcgcctcttcccagccgccatcccatctaggaagtgaggagcgtctctgcccggccgcccatcgtctgagatgtggggagcgcctctgccccgccgccccgtctgggatgtgaggagctcctctgcccggccgcgaccccgtctgggaggtgaggagcgtctctgtctggccaccccgtctgagaagtgaggagacctccgcccggcagccgccctgtctgagaagtgaggagcccctccgcccggcagccaccccatctgggaagtgaggagcgtctacgcccgggcagctgccccgtccgggagggaggtgggggggtcagccccccgcccggccagccgccccgtccgggagggaggtgggggggatcagccccccgcccggccagccgccccgtccgggagggaggtggggggcgcctctgcccggccgcccctgcccggccgcccctactgggaagtgaggagcccctctgcctggccaccaccccatctgggaggtgtgcccagcagctcattgagaacgggccatgatgacaatggcggttttgtggaatagaaaaggcggaaaggtggggaaaagattgagaaattggatggttgccgtgtctgtgtagaaagaagtagacatgggagacttttcattttgttctgtactaagaaaaattcttctgccttgggatcctgttgatctatgaccttacccccaacctggtgctctctgaaacatgtgctgtgtccactcagggttaaatggattaagggtggtgcaagatgtgctttgttaaacagatgcttgaaggcagcatgctccttaagagtcatcaccactccctaatctcaagtacccagggacacaaacactgcggaaggcggcagggtcctctgcctaggaaaaccagagacctttgttcacttgttgatctgctgaccttccctccactattgtcctatgaccctgccaaatccccctctgcgagaaacacccaagaatgatcaattaaaaaaaaaataatataataataattcttgtcctcttattttacactcataatgagaaatcacaagttctttcttgatgatctgtgctatagatttctactctgtctcctcaactctgttgatatttggggaaaattctgtttttcatagattctttgagatgctgatggaccagcttcagcatgtttgaggttgtctgaaatggagatcactgtaaaactgtctttttcttttaaattacaagtacactggggttaactgtattgctggaaaaacatcaagaatgacagtcttatatttaaggcaccagtcattgtttccattttttttttaattcttcccttggattaatattttctactgaaaagaaatgaaatctcagttccactatgataaaagaaacgaatcaccagtgtctgtcagtgcccccactgctcctcctcataccagcattgacactggtagctgaggaaggggactgctcaatttctaatgtgatctattcaagaagccacatataaaaaggcattgagggctcactgtccagagaattgcttttgtaaatgctccacaacgtatgggcaaaagtttaaggactactgcctgatgtaccaggaatcctgagttctgtgaaaatctgttcattccaaatctgttaagcatttccaaacatccagagaatggtttcactgttgagggtgcatgtggcagaatctgtctctctctgcacctgtcttctgttaccatccctggacagtgacagattttaagccagccaccagaattcttttcgagttaaccatttcttagtttctgtaaattcatgacttgtcttactgaactacagcctggtttgtagacttccaacatctacactgctgctcttcaccattggaattcactgtggtatttatagtattggcttcagtccgagccacaggcaataaaaggatatcagctgtagttctcagctacatcatggtgtatagatgctgttattcaggcgaacttgctcatgggtggactaacacctggtttggtacagagactgagaagtttttcattctggtgtcaaagttttgttacattatgggtgtgaagggcatttgatatatttttcttaactatggggtttatttttctaaatgtgggttgattgactgttaattgattcagggtacccttaaaagaaaagaagttttcccattgtgaaccttaaatgatcagagaagtaagttcattgattaaattctctgttgggagaacaaaacttttctcccttgacactttattatctttgatttttcaaagggccttgattggtggttgtgtctcggttaaaatttatgggactttgctatgtagttggcatttataaaatctgaagtatcataaataaagttatttatttaattatactaccagtcttttttactggtctgattcttttgtgcattcattaaagctgattgtgtgagagtgaactgggacacaagctagtctagctcactgcagccaagcaaaccctgttgatggctgatgggcctttccattagggttttgcttatgtgaagtaatggaattatgttggttattttctttatgaaaataaaccagttcttccaaggaagttaaaaggcttggtatggatgttggtgtcagataggtctgactaacctctccgtgctgcagcctatactaaggtgacccagggccacatgtagacagctaggccagtgctttttcctcttagggtttctttgcagaaagaaacctccagcaagggaagagaggtgtgtgtccacaggaaggggctccgtggggatcccatgaagggatttgagctctttcagctccatgtcatttaacttttttgtttaaccaccttggctttctctccttttttgctgtcctccttacggaccagttaccagattcagaggctaacagttagttacttgttaatgctagtcacagccaggaggtcagaaggaattttctacttctggatccaaatgttacctcttaggggaagttatgccccctcaactattgtcttattataatgaatctttcctttttggtccttttaagtaaccactcaaaacttttcatttcactgaaaaaatatgaaaaaccatgacaatagggctgggtgcagtggctcacgcctgtaatcttagcactttgggagaccaaggcaggcggatcgtttgaggccaggagtttgagaccagcctgggcaatgtagcaagactctgtctctgcaaaaaaaattaaaagatacctgagagctcactttaatatcaaggtatttgcatccattcccaccctgttagctcttaagggaggagggaaatcaattccaaccatactttcctgtgatggaagatgtttcctcttgaaaaaatgccaatacagatttttaaaacctattgttttccaaatgcactttgtaagtttttgcttttaaaatagcttcttggaaccaattttattgtatttgtacttaatttttgttctcatctaaatgtgcattttctgactgtatagaagaagctttggtatgtaatttaataataaattagaaatctaaatgattgcatttgtaattgtttatattgaaacagtaaccatcaaggtagtttggggatagagattatggtatctctggtgttgataagtgtttctcatgatgtcctgaaacccaggatgaaataatacaggtgctgaaaagctgtcacatgtcattcagaaaccatcatatgaacagtccactagtattttagccctagaagtgaaggggaatctcttaacatgaaacttcaggaggcataatgggaatctacaattgtagaattggctgggtgcagtggctaacacctgtaatcccagcagttcgagaggccgaggcaggaggattgcttgagaccagggatttgagaccagtctgggcaacacagcaaagaccttgtctctacaaaaactaaaattagccattcatgatggtgtgcacctatagtcccagctactcggaaggctgaggtaggaggatcatgagcccaggaggtcaaggctgcagtaagcaacgattgtgccactgtactccagcctgggtgacagagaccctgtctcaaaaataaattaattttttaaaaatcgtgtactgctgggctttagtacattagttgtgcaaccagccccactgtctaattttagagctttgcaattaatccagccagtgatcaattcctcttctataaaatggtgataaggatggctaccataattgtgccctgattatattgtcagggttatgtgaggaaatgctcataagcatctcagcaaagccaggggtacagggctcacctgacataa

SEQ ID NO: 138350 - DNA, 1204 bp, Homo sapiens
  Payload ID: 7097
  Gene Symbol: GOSR1
  Gene Name: golgi SNAP receptor complex member 1
  ENST ID: ENST00000427274
  CDS Start-End: 15-539
gttggacgacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaaagtgggtctggagtaaacaacagaagaactgagctatttttgaaagaacatgaccaccttcgaaaaggttttcagtggtgaagataaacttgaataaggagataacttacacaagcagaaaaagcctcatctcttctggattcctttaatgccagtggtcatcaccaggtgtagatcagtcaccttttacccaggctgggaccaccaccttctcatctacagctcagatcgtctgatagaagagacaataagcattgctatggcaacaaaagaaaatatgacttcacagagaggaatgttgaagtcaattcacagcaaaatgaacactttggccagtatcctttttgaatgttcgcagtctgtgttttgagggtagaggggagaagtgtctgtgtgtgcttttatagggggcaggttgccatcatcagtagcagtagagcccatcagtaattgcataatatgaatatactgtgcattcctactttgtgaaagtttatgctctttagtaccattcctaaaagactgcacctcagaagtttcttactactagatgtagaagaaaaaaattataaatgtgaatttaaaaattatccaccaatttcttctacattttagaaagcttttaaattcatgttagaactccacactatacattattcttacctaaacatgataaattatatgcctttgttgtttttcccatttagagataagtcagtggcagatgcttggaagggggaaggaag

SEQ ID NO: 138351 - DNA, 1231 bp, Homo sapiens
  Payload ID: 7097
  Gene Symbol: GOSR1
  Gene Name: golgi SNAP receptor complex member 1
  ENST ID: ENST00000451249
  CDS Start-End: 58-804
actttccggcctgcatcgcctctgctcccctatcccggctgacgttggacgacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaaagtgggtctggagtaaacaacagaagaactgagctatttttgaaagaacatgaccaccttcgaaactcagatcgtctgatagaagagacaataagcattgctatggcaacaaaagaaaatatgacttcacagagaggaatgttgaagtcaattcacagcaaaatgaacactttggccaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaattaaaaaaaaaaaaaaaaggttttcagttgcttttgtctccctaggaggcaggtaaaccaatcaaaaacagagttttctgtgtttccatgatagtgttgaagcctaatgacaagccaggtcttacagctgggctcttcagaaaaccaggtttctacatccaaagactgcttttcttttagctgccagattggattgtgaataaaaataattctt

SEQ ID NO: 138352 - DNA, 947 bp, Homo sapiens
  Payload ID: 7097
  Gene Symbol: GOSR1
  Gene Name: golgi SNAP receptor complex member 1
  ENST ID: ENST00000414833
  CDS Start-End: 1-767
agggaccagcagttactgggaaggtgagggcgagaaggcctccggatctcaggaaacaggctcgacagctggaaaatgaacttgacctgaaactagtttccttcagcaaactatgtacaagttacagtcatagcagtacccgagatggaagacgcgacaggtatagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaaagtgggtctggagtaaacaacagaagaactgagctatttttgaaagaacatgaccaccttcgaaactcagatcgtctgatagaagagacaataagcattgctatggcaacaaaagaaaatatgacttcacagagaggaatgttgaagtcaattcacagcaaaatgaacactttggccaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgt

SEQ ID NO: 138353 - DNA, 582 bp, Homo sapiens
  Payload ID: 7097
  Gene Symbol: GOSR1
  Gene Name: golgi SNAP receptor complex member 1
  ENST ID: ENST00000537788
  CDS Start-End: 12-257
ggacgacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacaggtataggaaaaactatcttgaaaacatttcccaagaaattctaccacaaactgaaactggctttgtagaattacttcagcctaactccccttctaaataaaaacctaaggccatgaggatcaggatttgatgtctattctaaagtgtcttgtttgatgcccagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatctt

SEQ ID NO: 138354 - DNA, 1011 bp, Homo sapiens
  Payload ID: 7097
  Gene Symbol: GOSR1
  Gene Name: golgi SNAP receptor complex member 1
  Uniprot ID: O95249
  ENST ID: ENST00000467337
  CDS Start-End: 223-780
ggacgacaaagatggcggcagggaccagcagttactgggaaggtgagggcgagaaggcctccggatctcaggaaacaggctcgacagctggaaaatgaacttgacctgaaactagtttccttcagcaaactatgtacaagttacagtcatagcagtacccgagatggaagacgcgacagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaaagtgggtctggagtaaacaacagaagaactgagctatttttgaaagaacatgaccaccttcgaaactcagatcgtctgatagaagagacaataagcattgctatggcaacaaaagaaaatatgacttcacagagaggaatgttgaagtcaattcacagcaaaatgaacactttggccaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaattaaaaaaaaaaaaaaaa

SEQ ID NO: 138355 - DNA, 756 bp, Homo sapiens
  Payload ID: 7097
  Gene Symbol: GOSR1
  Gene Name: golgi SNAP receptor complex member 1
  ENST ID: ENST00000581721
  CDS Start-End: 8-718
gacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacaggtatagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgatgggtctggagtaaacaacagaagaactgagctatttttgaaagaacatgaccaccttcgaaacattgctatggcaacaaaagaaaatatgacttcacagagaggaatgttgaagtcaattcacagcaaaatgaacactttggccaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttc

SEQ ID NO: 138356 - DNA, 1026 bp, Homo sapiens
  Payload ID: 7097
  Gene Symbol: GOSR1
  Gene Name: golgi SNAP receptor complex member 1
  ENST ID: ENST00000610619
  CDS Start-End: 12-539
ggacgacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacaggtatagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggtaatatattgggctcgagatgttttcattatcacaggagtttgggtttttttttttaatccctgcattggatatgtgcacatatatttaaaaggacaaagagaaaaatctgagaaaataaatgccatgctaaagggacttgttttacttttttttggggtcaccattataaaattctgaaaatatctaatagctcttgctatttcttggcgaagttgagtaatattcatcactgggtacatatacttccactatgggagacctagctagctagctgtaacagtgaaatagccaatggtcatgtatagacaataacgtggtgggtaagcgtgtactttcagctagctttgaagataatatggagggggaattatttactatacttagtatattgtttaagaaaacagtaaatgtgtatgcaccaataaaactaaataaacttttaaagatttaaatggaggatatgttaaaaatatggtagtacaaatagaaaggactttctaaataagacttgatactggaaaccataacgaatggctaatttgcttactacacagagatataatagaaataagaaaaagacagtaggaaaatggacaaaggatataaaattgcttacaaaaaaatgaatggccaaaactataaaaacattttcagcagtatttcc

SEQ ID NO: 138357 - DNA, 994 bp, Homo sapiens
  Payload ID: 7097
  Gene Symbol: GOSR1
  Gene Name: golgi SNAP receptor complex member 1
  ENST ID: ENST00000620049
  CDS Start-End: 12-779
ggacgacaaagatggcggcagggaccagcagttactgggaaggtgaggcgagaaggcctccggatctcaggaaacaggctcgacagctggaaaatgaacttgacctgaaactagtttccttcagcaaactatgtacaagttacagtcatagcagtacccgagatggaagacgcgacagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaaagtgggtctggagtaaacaacagaagaactgagctatttttgaaagaacatgaccaccttcgaaactcagatcgtctgatagaagagacaataagcattgctatggcaacaaaagaaaatatgacttcacagagaggaatgttgaagtcaattcacagcaaaatgaacactttggccaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaatt

SEQ ID NO: 138358 - DNA, 855 bp, Homo sapiens
  Payload ID: 7098
  Gene Symbol: GOSR2
  Gene Name: golgi SNAP receptor complex member 2
  Uniprot ID: O14653
  ENST ID: ENST00000225567
  CDS Start-End: 32-673
agccggagccgtggcctgcggggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtgg

SEQ ID NO: 138359 - DNA, 847 bp, Homo sapiens
  Payload ID: 7098
  Gene Symbol: GOSR2
  Gene Name: golgi SNAP receptor complex member 2
  Uniprot ID: O14653
  ENST ID: ENST00000393456
  CDS Start-End: 58-696
gtgaggacgtgttccgaggaagccagagccggagccgtggcctgcggggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaa

SEQ ID NO: 138360 - DNA, 2202 bp, Homo sapiens
  Payload ID: 7098
  Gene Symbol: GOSR2
  Gene Name: golgi SNAP receptor complex member 2
  Uniprot ID: O14653
  ENST ID: ENST00000415811
  CDS Start-End: 56-643
gaggacgtgttccgaggaagccagagccggagccgtggcctgcggggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggtggggtccctgctgggggacagagagaaggcctcttgttttagcctcatccaacagtttagtaactgtgtttatattttgattacgtgtcctcaaattgtgatattttgatgacaagacagagcccttgagtttgggatcctttctgttggagttgagttattgtgagcctgaaagtacccagttcctttgccagtgcttgaaacaaaccatgaagtggcctctcttaggatccaggtcttttcccatttactgaacttatcatgaaagtgagtgctactacgaggggtccaatcacaggctgagaaattgtgttacagaatctactcttggaagaatgaagacgtggctgtcctttggtacctcgctttaaggtggctttcccttaggacccctactgtggactgccttataactaaaaccttttgtattttagtaactgaatccccactgtgcagtgttagggctgcctggttgtttgcagtagattagagctttagaagcttctagagcttctaaagcccgtgctggtgatcccagcgactcttcactccctagccttaggtattcctagaagccctgaccagttggcactgctgagactccagcccctgggagtggtttacagaaacattacacagactctgatgtcagtcatgatgtttcagcctctgcccttttcctgtatcaaccctgatggataatagggcgtgggttctgtctgttatcagggtgtggtcccctgtgaatgaagcactcccagccactgagctgtgagaaacagtcactcggaagtgtgagctttatcttagtttttgttggatcatgttgagtctgtcagctccacaggacttcagtacgtttctgaacagtccctgccatctctacgggggagagggtcaggcaagctgcaagtgacactcacctcctgctgacagttgcagtgtctcagatggcctggaagggtggtctccagcagcctgctgggcgctcccctttcatgagagccacctgcagtgacctgaactgatacatgttgattagtctgccctttctttagaaaactgctactctccttttcatatctcagaaaaacagtagaggccttttaggaccaaactccatgtcacactgatgaagagccagtgggggttagagcgtcctgttaaggcacatgctaacttcccactcaagtctggcagcgctggggcatcagcacacctcttgccacccacactgataccagaggggaaggctgtgaggtggctgggggttgagacttgaggtttctaactttcctctgcacacctgtggctacctggtgtttgtctcttgattccctccacctgcctcacaccctgcctccgtcgggattttccacctacaccattcaaaaggaacataggagagggcatgaaggggctaggctgaagcactctgatgactggggccaatttgtggctgaaaatgaatacattttttgaaatttatggtcattttcaagtgatttagaaggttgatccttagcctcatacagtgatgaaataatctgtgtgttcagagccaagcaggactttagcaagagtctgattgtattgtcactatctcggggaaaaaaaaatacaaatacatttctctgatctctgatggcaatgaagtttgacttgtaa

SEQ ID NO: 138361 - DNA, 597 bp, Homo sapiens
  Payload ID: 7098
  Gene Symbol: GOSR2
  Gene Name: golgi SNAP receptor complex member 2
  ENST ID: ENST00000570879
  CDS Start-End: 1-597
atcccctgttccagcaaacgcacaagcaggtccacgagatccagtcttgcatgggacgcctggagacggcagacaagcagtctgtgcacatagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggtgggatgctgctgacctgtg

SEQ ID NO: 138362 - DNA, 643 bp, Homo sapiens
  Payload ID: 7098
  Gene Symbol: GOSR2
  Gene Name: golgi SNAP receptor complex member 2
  ENST ID: ENST00000575949
  CDS Start-End: 41-472
ggaagccagagccggagccgtggcctgcggggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgtaagccaggcccgtggtgagggtcggcctgcacttgacagatcgtgggggctggagttcagatctctgagcgccatctgttttgggggtgtctgaagaagactgatgatgaggaaaccaactggaaatgacaggaactttgtgcattgccacagagactagacctagacagagaatccctttttctaagacaaaaacctgaagaggaagcagttaaattgaaggggaataggcagaggtgaaaattacctggttgggctggtctga

SEQ ID NO: 138363 - DNA, 648 bp, Homo sapiens
  Payload ID: 7098
  Gene Symbol: GOSR2
  Gene Name: golgi SNAP receptor complex member 2
  ENST ID: ENST00000572403
  CDS Start-End: 200-648
gtggcctgcggggccggcgacatggatcccctgttccagcaaacgcacaagttataaaactttgtccagcacttgtcaactcggtgctcctggttggtagacctcgagaggagacacggagtaggagacacggcccctggccgtaggagtgtactgtttaattggagagtcagggcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgggactcagaagaagatccttgacattgccaacatgctgggcttgtccaacacagtgatgcggctcatcgagaagcgggctttccaggacaagtactttatgatagacaaagaacatatgttcttgacaagggagtgtgccttgttccccacccacagtcaccactg

SEQ ID NO: 138364 - DNA, 1674 bp, Homo sapiens
  Payload ID: 7098
  Gene Symbol: GOSR2
  Gene Name: golgi SNAP receptor complex member 2
  ENST ID: ENST00000576910
  CDS Start-End: 77-574
ggaaaccggaaggggggctgtgaggacgtgttccgaggaagccagagccggagccgtggcctgcggggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacatagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaa

SEQ ID NO: 138365 - DNA, 592 bp, Homo sapiens
  Payload ID: 7098
  Gene Symbol: GOSR2
  Gene Name: golgi SNAP receptor complex member 2
  ENST ID: ENST00000573224
  CDS Start-End: 1-297
gggactcagaagaagatccttgacattgccaacatgctgggcttgtccaacacagtgatgcggctcatcgagaagcgggctttccaggacaagtactttatgatagagacaaggtctcaccatgttgcccagaatggacccgaactcctgagctcaagagatcctcctgcatcagcctcccgaagtgctgggattataggtatgagccaccaccctgacctccaaataccttttgaactcaggcttggatttgaactctggttctatcaactattagctgtgatttcagatcagtgacttgagcaatttgtgccttgtttcattaagtggagatgacaatagcacctgccttgcaagaattatttgatgtggccgatgagaaaaatcagaattatgaaaagtgcttcacaccattcctggcatgtgaagagccctctctaaatggccattatgctaattagcaccttaaagggaaatcattttcatgaaattttatttgaatctggctagagaaaatgctcaccttcttccttgtgttttgcttatttgattaaatgtctttgatttctgtgatgtgtgaagtcccttgaaa

SEQ ID NO: 138366 - DNA, 2090 bp, Homo sapiens
  Payload ID: 7099
  Gene Symbol: GET4
  Gene Name: golgi to ER traffic protein 4
  Uniprot ID: Q7L5D6
  ENST ID: ENST00000265857
  CDS Start-End: 95-1078
gtagaagggcgtcgggcggccgtcgggacggaagccgggaggcgctgccgaccgcgcctgcgacagcgtcagccctgcgcggagcgccggcccgatggcggcggcggcggcgatggccgagcaggagagcgcccggaacggcggccgcaaccgcggcggcgtccagcgtgtggagggcaagctgcgcgccagcgtcgagaagggcgactactacgaggcgcaccagatgtaccggaccctgttcttcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggtgggaagctgacggtgttcactgtgctgtgtgagcagtaccagccatccctccggcgggaccccatgtacaacgagtacctcgaccgcataggacagctgttcttcggcgtcccgcccaagcagacgtcttcctacgggggcctgctcgggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgatgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgg

SEQ ID NO: 138367 - DNA, 4356 bp, Homo sapiens
  Payload ID: 7099
  Gene Symbol: GET4
  Gene Name: golgi to ER traffic protein 4
  Uniprot ID: Q7L5D6
  ENST ID: ENST00000407192
  CDS Start-End: 2518-3342
tgttttggccggcagagagcaccagcgctcactggctctcagcgcctgtcagcaggcagaagccatttccctatctggaaggcacgtctgggtgtccacatggcacggccaatagtgcgcagcatgcagagccgggccgggagaaggcccggccatgcccagctgccccccactctccccggcctcgggcttgagagggtacctgtcctggcttagtcacctggaaaccaaaatccttcgcagcttccagaattctccagtacaggaggagaagccgtccacgttcagagccgccttagacggtttgcctgtcaccggcattcctggacctggaaacgggtgcccccagccaggccggggaccactgtgtgcccagaattctcctcccgtcctttttccccttgcccggctcccagctgcccagggaagaagggagccggctgcaaggcgcagtccaaaccaggccgggggccgtgaccatcggcagtgccccccagagcaggctcctcgtgcaggaatatgggtcactgccttccagggagtcctttttttcttctggtttctaagtcgccacctcttgctttacctcagatagaagcatccagaacgctgtagtatcggcaaagcagaagctggtgtggtgcttgctcagggtcggtgcatgcggttctgcccgtggccccactggcggcatcgtgaggccaggcgtgtctgggagcttgtttttccagagtgccctgtgccagacggctcccggcctcctctgagtcagtcatgtccctgcaggactggaactaggacggccggtcacagagtcagtggtcctgtcgaggctcctgctgtggtgttggggtgggtctccctccagaaccttcactgtgcggggagcacagcaaaaccggaggcctgccaacggcctgcaggctgacgggggtgcgggggcactttctctcttgggtgcgggcttttccctcctggtgccctgcctctgtgcagcacgaagcggtctcctgtggggggagggcctgtgtgccaggctaatgagatgcccggatgtggcggggctgtctgtgtttggggtccctggctgtggtgccttctgaagaggagcccttttctgtggttaactgagcatccaaccctttgcgttctcggctggccttcccgtcctggcaacaccaaggtcattctggtcctcagtggcgttgctgtggctctttatcacctccactgcaattggtttttgtttgtttgttttggggggatggcgcctcgctctgtcatccgtctaggcagtggtgcaatcatggcttactgcggccttgactacccggactcaagcagtcctcccacctcagcctcccgagtagctgggaccacaggtgcacaccaccatgcccagctaatttctgtgttttttgtagagacagggtctcactatgttgctcaggccagtctcaaactcatgagctcaagcgatcctcccacctcagcctcccaaagggctgagattacaggtgtgagcccccgaatccggtgtgcactgctgtttacttagtatttttctttaactagatttatttttaaacaaggctttgtccaaggacatttggctcgcaggcacagagctgattaactcgttatgtatcttttgataataaggcagcgatcattaagaaaaacgtgtagccaatgaaataacatgttctgggccccaccactggactgggaggtgcagcgcatccaagcagaggctgcctcctgccctccacgcctgctgctctcgcaggcaggggctctgctgcttacagcagtgcggccatctcggcttctctccacatcgtctgtcacgcgctggtccccaccatacctctcgccaccccgtgcctctgtccccgtgcggcctgaggagctccagctttccctgccagcggtgctctgggagtggggacgtgatgcagggcgagcatgatgcaacggggcaccccagacccttccctcccgtggggggaggggtgtggcacgcagaggggcagagggcggggacactggccccgtgggggaagaaggtgctgtcacagccgttactgtcccccgtgggaccccagcctggagccccccatcctttggctcctgcctgtggccactcagctctcaggtggccacatgcacatcccctgctccttccctgcgcacctgccctgcccagtggcctttctggtcccagctactgaaaccggtgagctgctccagggtgaggctgctttctggctcctggtgtatttggacacagataggcccttagtgtccagaggcgccccatgcagccctcatggtcagcaggacacccaggatagaccccctccacgcagcacctgggccctgggagcggctgcttttaggatgccacctgttcctgggcgccttgtttttagcttctgacctgaagatgagcgggggagcgcggtggcgagggcacgtgggcgtggctcacggtctcctctctgtggcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggtgggaagctgacggtgttcactgtgctgtgtgagcagtaccagccatccctccggcgggaccccatgtacaacgagtacctcgaccgcataggacagctgttcttcggcgtcccgcccaagcagacgtcttcctacgggggcctgctcgggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgatgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggc

SEQ ID NO: 138368 - DNA, 682 bp, Homo sapiens
  Payload ID: 7099
  Gene Symbol: GET4
  Gene Name: golgi to ER traffic protein 4
  ENST ID: ENST00000441491
  CDS Start-End: 181-682
cggcagtgccccccagagcaggctcctcgtgcaggaatatgggtcactgccttccagggagtcctttttttcttctggtttctaagtcgccacctcttgctttacctcagatagaagcatccagaacgctgtagtatcggcaaagcagaagctggtgtggtgcttgctcagggtcggtgcatgcggttctgcccgtggccccactggcggcatcgtgaggccaggcgtgtctgggagcttgtttttccagagtgccctgtgccagacggctcccggcctcctctgagtcagtcatgtccctgcaggactggaactaggacggccggtcacagagtcagtggtcctgtcgaggctcctgctgtggtgttggggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaag

SEQ ID NO: 138369 - DNA, 502 bp, Homo sapiens
  Payload ID: 7099
  Gene Symbol: GET4
  Gene Name: golgi to ER traffic protein 4
  ENST ID: ENST00000426056
  CDS Start-End: 27-502
actcctagtccctgctgctctgggagatgccccgggccagagccaggtacccagagcggccacagctgttcctggactccagctccccacggcaccttccccagcccccgcctcggccagggcgtccgtccttccttcctcgctgtgctctggggcacatggcgctggaactgcggtgggcagctcagtgtggtggtccacggctcactcagggacgcccagcagaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggccca

SEQ ID NO: 138370 - DNA, 873 bp, Homo sapiens
  Payload ID: 7099
  Gene Symbol: GET4
  Gene Name: golgi to ER traffic protein 4
  ENST ID: ENST00000412734
  CDS Start-End: 428-873
cttgcctcccccaccttcccccctggcctccacctgttccgcattcccccacctccctgcctccctcctcctggccttcaggttctccagccgggccctacaccgggctccgtaggaagtcgctggcgttcctctcaccgagggtccaggctgagggtgaaaccgcttctctgttgacgccgcccggcctgccgaaccgagtcagccgcctctggacctaggctcggtgacacctgcacggccggtgtagcctggagggcgagcgcgagcagagctggctatgctgggttaactgcacgcccctcgggactgtgaccgcttggaagttccaggctgctgcgtggcttggttgattgtcttcaggactgctctgttccagtatttttgctgtcatacagttactgcagaatgttcagttgttctgtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctaca

SEQ ID NO: 138371 - DNA, 883 bp, Homo sapiens
  Payload ID: 7100
  Gene Symbol: GOLT1A
  Gene Name: golgi transport 1A
  Uniprot ID: Q6ZVE7
  ENST ID: ENST00000308302
  CDS Start-End: 187-585
agtagaagcacctgcgtggtgtgcgggggtggagcgggggctggagggagagttaatgatttgccacaggctcatttcgcaacttaaccaagggtcagcttcccgtgaccatgtaccagctgcgtcctctgggccacgctccacttgcccgcttccacccggaaagccccccaggctgagtgcggcatgatctccatcaccgaatggcagaagattggtgtggggatcaccggtttcggcatcttcttcatcctctttggaacactcctgtactttgattccgtgctcctggcctttggaaacctgctgttcctgacgggcctgtccctcatcattggcctgaggaagaccttttggttcttcttccaacggcacaaactcaagggaaccagcttcctcctggggggtgtggttatcgtgctcctacgctggcccctcctcggcatgttcctggaaacctacggattcttcagcctctttaagggctttttccctgtcgccttcggcttcctgggcaatgtctgcaacatccccttcctgggtgcgctgttccggagacttcaaggcactagctcgatggtctgaaaaacagagatgagctccttgaacttggatcattggttgagggggctagagggagaatgggaaccaccccctcagtcccctgcactgactcactccccgacatatccggacctccccaagtccagaaggaaggaatggagctgagcaactgacgtcaaatccccaagtcgactcaagaggctgccaggaagcagagatgcagaccccaaggagactgggctggggctggtatcacaccctcactctatatttatgggaggaaaagtgaagattaaattcccaagttgtgcgtgtgtct

SEQ ID NO: 138372 - DNA, 3227 bp, Homo sapiens
  Payload ID: 7101
  Gene Symbol: GOLT1B
  Gene Name: golgi transport 1B
  Uniprot ID: Q9Y3E0
  ENST ID: ENST00000229314
  CDS Start-End: 110-526
agacgtggcggctctcgcctgggctgtttcccggcttcatttctcccgactcagcttcccaccctgggctttccgaggtgctgtcgccgctgtccccaccactgcagccatgatctccttaacggacacgcagaaaattggaatgggattaacaggatttggagtgtttttcctgttctttggaatgattctcttttttgacaaagcactactggctattggaaatgttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaaatgtccactgcaatggcaaaaatatttccagttgcactgtatctctggaagtgatgcatgaattcgattggattgtgtcattttaaagtattaaaaccaaggaaaccccaattttgatgtatggattacttttttttgtaaacatggttaaaataaaacttttgtggttcttctgaatcttaatatttcaaagccaggtgaaaatctgaactagatattctttgttggaatatgcaaaggtcattctttactaacttttagttactaaattatagctaagttttgtcagcagcatactccggaaagtctcatacttcttgggagtctgccctcctaagtatctgtctatatcattcattacgtgtaagtatttaacaaaaaagcattcttgaccatgaatgaagtagtttgtttcatagcttgtctcattgaatagtattattgaagatactaaatgatgcaaaccaaatggattttttccatgtcatgatgtaatttttctttcttctttcttttttttaaattttagcagtggcttattatttgtttttcataaattaaaataacttttgataatgtttactttaagacatgtaacatgttaaaaggttaaacttatggctatttttaaagggctattcatttaatctgagttttcccttattttcagctttttcctagcatataatagtcattaagcatgacatatccttcatatgatcactcatcttgagttaattagaaaatacctgagttcacgtgctaaagtcatttcactgtaataaactgactgtggtttcttaagaacatgacactaaaaaaaaagtgttttttttccaccgttgctgattattagacagtaggaaatagctgttttctttagttttacaagatgtgacagctttagtggtagatgtagggaaacatttcaacagccatagtactatttgttttaccactgattgcactgttttgtttttttaacagttgcaaagctttttaatgcataaaagtataattgaaatctgtggtatttatttacaaacatgtctacaaaaatagattacagcttattttatttttagttaaatctcttaatacacagagaactcccaatcttgctcatctaaataaggaaagacttggtgtatagtgtgatggtttagtcttaaggattaagacatttttggtacttgcatttgacttacgatgtatctgtgaaaatgggatgatattgacaaatggagactcctacctcaatagttaatggaataataagaggctactgttgtgtctaatgttcttcaaaaaagtaatatcctcacttggagagtgtcaaatacatactttgaggattgactttatataaggtgccctgtagaactctgttacacatatttttgacccatattatttacaatgtcttgataattctacctttttagagcaagaatagtatctgctaatgtaagggacatctgtatttaactcctttgtagacatgaatttctatcaaaatgttctttgcactgtaacagagattccttttttcaataatcttaattcaaaagcattattagacttgaaagggtttgataatctcccagtccttagtaaagattgagagaggctggagcagttttcagttttaaatgagtctgcagttaatatcaaatgtgagtttgggactgcctggcaacatttatatttcttattcagaacccttgatgagactatttttaaacatactagtctgctgatagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgtcagattatattatctaacaattgaatattgtaaatatacttgtcttacctctcaataaaagggtacttttctattaattggtggtcaagtatatctgtgttatgaagttctaaaagctaatttagcattgcaaaataacctcatttttaaaaaattagccttatatgcagtgttctatttatcaaatgatcttcacatctttcatttccaaattgttgaaatgtactaatgaatacaaatagacttcaagtaagcaaaaatgttcttaattttgaaaactgtaaaataaagtcacttaccttgggcaatatgctattttttaaaaa

SEQ ID NO: 138373 - DNA, 1055 bp, Homo sapiens
  Payload ID: 7101
  Gene Symbol: GOLT1B
  Gene Name: golgi transport 1B
  ENST ID: ENST00000540141
  CDS Start-End: 110-496
agacgtggcggctctcgcctgggctgtttcccggcttcatttctcccgactcagcttcccaccctgggctttccgaggtgctgtcgccgctgtccccaccactgcagccatgatctccttaacggacacgcagaaaattggaatgggattaacaggatttggagtgtttttcctgttctttggaatgattctcttttttgacaaagcactactggctattggaaatgttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcaactacataggcccagaagagatccacagtaatgtttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaaatgtccactgcaatggcaaaaatatttccagttgcactgtatctctggaagtgatgcatgaattcgattggattgtgtcattttaaagtattaaaaccaaggaaaccccaa

SEQ ID NO: 138374 - DNA, 876 bp, Homo sapiens
  Payload ID: 7101
  Gene Symbol: GOLT1B
  Gene Name: golgi transport 1B
  ENST ID: ENST00000539663
  CDS Start-End: 101-229
ggctctcgcctgggctgtttcccggcttcatttctcccgactcagcttcccaccctgggctttccgaggtgctgtcgccgctgtccccaccactgcagccatgatctccttaacggacacgcagaaaattggaatgggattaacaggatttggagtgtttttcctgttctttggaatgattctcttttttgacaaagcactactggctattggaaataaactcctgtagcctatgatgaatatttcagaaccaagaggaatacccttgggtgacatatttatgggcagctttcctctttatgccttgccaactcatctgcttgactaagccttcctcatccagctaaaactaggaaaactactgcagacacagatgccccttggttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcaactacataggcccagaagagatccacagtaatgtttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaag

SEQ ID NO: 138375 - DNA, 562 bp, Homo sapiens
  Payload ID: 7101
  Gene Symbol: GOLT1B
  Gene Name: golgi transport 1B
  ENST ID: ENST00000542194
  CDS Start-End: 72-194
atttctcccgactcagcttcccaccctgggctttccgaggtgctgtcgccgctgtccccaccactgcagccatgatctccttaacggacacgcagaaaattggaatgggattaacaggatttggagtgtttttcctgttctttggaatgattctcttttttgacaaagcactactggctattggaaatgaatgaaacctgtcagctttctgtttaaataaaaggttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgtt

SEQ ID NO: 138376 - DNA, 933 bp, Homo sapiens
  Payload ID: 7101
  Gene Symbol: GOLT1B
  Gene Name: golgi transport 1B
  ENST ID: ENST00000542038
  CDS Start-End: 232-456
agggtggctgcgtgtttccggaagacgtggcggctctcgcctgggctgtttcccggcttcatttctcccgactcagcttcccaccctgggctttccgaggtgctgtcgccgctgtccccaccactgcagccatgatctccttaacggacacgcagagttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaaatgtccactgcaatggcaaaaatatttccagttgcactgtatctctggaagtgatgcatgaattcgattggattgtgtcattttaaagtatt

SEQ ID NO: 138377 - DNA, 1210 bp, Homo sapiens
  Payload ID: 7101
  Gene Symbol: GOLT1B
  Gene Name: golgi transport 1B
  ENST ID: ENST00000539025
  CDS Start-End: 96-224
tcgcctgggctgtttcccggcttcatttctcccgactcagcttcccaccctgggctttccgaggtgctgtcgccgctgtccccaccactgcagccatgatctccttaacggacacgcagaaaattggaatgggattaacaggatttggagtgtttttcctgttctttggaatgattctcttttttgacaaagcactactggctattggaaataaactcctgtagcctatgatgaatatttcagaaccaagaggaatacccttgggtgacatatttatgggcagctttcctctttatgccttgccaactcatctgcttgactaagccttcctcatccagctaaaactaggaaaactactgcagacacagatgccccttggttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaaatgtccactgcaatggcaaaaatatttccagttgcactgtatctctggaagtgatgcatgaattcgattggattgtgtcattttaaagtattaaaaccaaggaaaccccaattttgatgtatggattacttttttttgtaaacatgg

SEQ ID NO: 138378 - DNA, 223 bp, Homo sapiens
  Payload ID: 7101
  Gene Symbol: GOLT1B
  Gene Name: golgi transport 1B
  ENST ID: ENST00000631252
  CDS Start-End: 95-223
cgcctgggctgtttcccggcttcatttctcccgactcagcttcccaccctgggctttccgaggtgctgtcgccgctgtccccaccactgcagccatgatctccttaacggacacgcagaaaattggaatgggattaacaggatttggagtgtttttcctgttctttggaatgattctcttttttgacaaagcactactggctattggaaataaactcctgtag

SEQ ID NO: 138379 - DNA, 4590 bp, Homo sapiens
  Payload ID: 7102
  Gene Symbol: GOPC
  Gene Name: golgi-associated PDZ and coiled-coil motif containing
  Uniprot ID: Q9HD26
  ENST ID: ENST00000052569
  CDS Start-End: 241-1605
ggggcaggctgggaggtgggactgactgagtcttccgtgtgtcgccgccgttgccgcctcagcttcagcctcgttactcctgcggttctgtgactgtgctgctggcgttaacggcgcgaggtgaagggaggtgacggagtgtgcccgcgcgcgcgggggtcccctcagtcccagcagttcccttcgtgcgcggggggcggcgagggtcttcagcagtcgggagaggcccttgacggcgccatgtcggcgggcggtccatgcccagcagcagccggagggggcccagggggcgcctcctgctccgtgggggcccctggcggggtatccatgttccggtggctggaggtgctggagaaggagttcgacaaagcttttgtggatgtggatctgctcctgggagagatcgatccagaccaagcggacatcacttatgaggggcgacagaagatgaccagcctgagctcctgctttgcacagctttgccacaaagcccagtctgtgtctcaaatcaaccacaagctggaggcacagttggtggatctgaaatctgaactgacagaaacccaagcagagaaagttgttttggagaaagaagtacatgatcagcttttacagctgcactctattcagctgcagcttcatgctaaaactggtcaaagtgctgactctggtaccattaaggcaaaattggaaagagagcttgaggcaaacaaaaaagaaaaaatgaaagaagcacaacttgaagctgaagtgaaattgttgagaaaagagaatgaagcccttcgtagacatatagctgttctccaggctgaagtatatggggcgagactagctgccaagtacttggataaggaactggcaggaagggtccaacagatacaattgctaggacgagatatgaagggacctgctcatgataagctttggaaccaattagaagctgaaatacatttgcatcgtcacaaaactgtgatccgagcctgcagaggacgtaatgacttgaaacgaccaatgcaagcaccaccaggccatgatcaagattccctaaagaaaagccaaggtgttggtccaattagaaaagttctcctccttaaggaagatcatgaaggccttggcatttcaattacaggtgggaaagaacatggtgttccaatcctcatctctgagatccatccggggcaacctgctgatagatgcggagggctgcacgttggggatgctattttggcagtcaacggagttaacctaagggacacaaagcataaagaagctgtaactattctttctcagcagagaggagagattgaatttgaagtagtttatgtggctcctgaagtggattctgatgatgaaaacgtagagtatgaagatgagagtggacatcgttaccgtttgtaccttgatgagttagaaggaggtggtaaccctggtgctagttgcaaagacacaagtggggaaatcaaagtattacaaggatttaataagaaggcagtaactgacacacatgaaaatggagacctgggcactgcaagtgaaactccgctagatgacggtgcttcaaaattagatgatctgcacactctgtatcataaaaaatcttattaaattgaccatatctccagacaagattgttaatcagactattctgaatttggggcactggggaagatggtgacaaagactacaaaatcaggggaggctgtttgttgcctaaatgaaaggcgggtacctcagggcttcatgtgaacaattctcaatgcataaaacaccctgttttctgtggtagaccataattagctattgcatgtaaagcaattttgattttcttgaacttgtaagcaccaaagcatgtgtttcccaaaggggtattactgggctcttaagtaccaaatgaaaccctactgttttacttggttccttttccctttagtaggaggacagtgctaactggaattttataaggagtaccctttaaaatacagagagtaagtgaattcatattttatattctagaatgttaactgtggtatttcagaagacagagcttgactcaatgaattgtagaaatataggcttgacttaatttttgtaactgaaaggctttagacttaaaaaaatttattgtgcatcctaaaatctaaaccaattattaatgatcatttattgtaatgagtttgcatttcagctttattcaatgcagtacaaaatagttttctttaagcagtcttttatcaatcaatgctgcactagaaatagattctcaaaagttactaaacattttactttttttgttttttaaaagaaatgcagatgagtgtaaaacatctgttctcaattatgttgatctgtgtgcgcagtactggagcatttacccattcatgttgagcctcaaatgcttgttttctggggtccacaaaagacagttttatacattttgagttgttcataaagtttgtcttgtgatagtcctggcacttaaagacaaatttttctggtagtaaaagttcagatttattactatgtcatgaaacacagtacattcaaatcaaacggcagttttctttctaagtaaatgatttccagtcatctaaaaggtgggcaagatgagataaagacattttgatacagtaattgttttggttgggttttcatgtcagtttatgtttgactaaagctctcttcatatgcaggtttataaatttgttaggtctgttgtcccatgattaaacatggagtgcctcctctctgatttaatattctgcaggtcattgtaacctgctaggcaaagtcacaacattgcattaaagaggtgatagctttgctaatatcactgttttaaaggacgtacagttaaaggaatattaagtgggagaaagcctacaaggcttttagaatattatcagtatcttcatttctggtattcagatgttatgtgataaaacacattttttttggctttcccagatacactatatatttgttcaagggtaaatctataaaatgtatatactttattttgtggttttgctatttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaacagctatcgaaagttagcacagcttgtctgtggtgctgtttttttccccactgcagtggacttatgctgttttcatgtttagaaacaaaaaggtttcatgtgattcatgtgtaagatgcacagtatttgacatcctgattatgtaatccctattccatctatccagtcttacacttatggttggcctcaaatctattgcatttatgataatgtattatatctagttgagtttaatatttttttattagcctgtaaataaagatggcatcttctacattaaaatgatattgatctcatttttttaaataaacattttgtttccttgacgttaaa

SEQ ID NO: 138380 - DNA, 4450 bp, Homo sapiens
  Payload ID: 7102
  Gene Symbol: GOPC
  Gene Name: golgi-associated PDZ and coiled-coil motif containing
  Uniprot ID: Q9HD26
  ENST ID: ENST00000368498
  CDS Start-End: 77-1465
tcagtcccagcagttcccttcgtgcgcggggggcggcgagggtcttcagcagtcgggagaggcccttgacggcgccatgtcggcgggcggtccatgcccagcagcagccggagggggcccagggggcgcctcctgctccgtgggggcccctggcggggtatccatgttccggtggctggaggtgctggagaaggagttcgacaaagcttttgtggatgtggatctgctcctgggagagatcgatccagaccaagcggacatcacttatgaggggcgacagaagatgaccagcctgagctcctgctttgcacagctttgccacaaagcccagtctgtgtctcaaatcaaccacaagctggaggcacagttggtggatctgaaatctgaactgacagaaacccaagcagagaaagttgttttggagaaagaagtacatgatcagcttttacagctgcactctattcagctgcagcttcatgctaaaactggtcaaagtgctgactctggtaccattaaggcaaaattgtctggcccctctgtggaggagctggaaagagagcttgaggcaaacaaaaaagaaaaaatgaaagaagcacaacttgaagctgaagtgaaattgttgagaaaagagaatgaagcccttcgtagacatatagctgttctccaggctgaagtatatggggcgagactagctgccaagtacttggataaggaactggcaggaagggtccaacagatacaattgctaggacgagatatgaagggacctgctcatgataagctttggaaccaattagaagctgaaatacatttgcatcgtcacaaaactgtgatccgagcctgcagaggacgtaatgacttgaaacgaccaatgcaagcaccaccaggccatgatcaagattccctaaagaaaagccaaggtgttggtccaattagaaaagttctcctccttaaggaagatcatgaaggccttggcatttcaattacaggtgggaaagaacatggtgttccaatcctcatctctgagatccatccggggcaacctgctgatagatgcggagggctgcacgttggggatgctattttggcagtcaacggagttaacctaagggacacaaagcataaagaagctgtaactattctttctcagcagagaggagagattgaatttgaagtagtttatgtggctcctgaagtggattctgatgatgaaaacgtagagtatgaagatgagagtggacatcgttaccgtttgtaccttgatgagttagaaggaggtggtaaccctggtgctagttgcaaagacacaagtggggaaatcaaagtattacaaggatttaataagaaggcagtaactgacacacatgaaaatggagacctgggcactgcaagtgaaactccgctagatgacggtgcttcaaaattagatgatctgcacactctgtatcataaaaaatcttattaaattgaccatatctccagacaagattgttaatcagactattctgaatttggggcactggggaagatggtgacaaagactacaaaatcaggggaggctgtttgttgcctaaatgaaaggcgggtacctcagggcttcatgtgaacaattctcaatgcataaaacaccctgttttctgtggtagaccataattagctattgcatgtaaagcaattttgattttcttgaacttgtaagcaccaaagcatgtgtttcccaaaggggtattactgggctcttaagtaccaaatgaaaccctactgttttacttggttccttttccctttagtaggaggacagtgctaactggaattttataaggagtaccctttaaaatacagagagtaagtgaattcatattttatattctagaatgttaactgtggtatttcagaagacagagcttgactcaatgaattgtagaaatataggcttgacttaatttttgtaactgaaaggctttagacttaaaaaaatttattgtgcatcctaaaatctaaaccaattattaatgatcatttattgtaatgagtttgcatttcagctttattcaatgcagtacaaaatagttttctttaagcagtcttttatcaatcaatgctgcactagaaatagattctcaaaagttactaaacattttactttttttgttttttaaaagaaatgcagatgagtgtaaaacatctgttctcaattatgttgatctgtgtgcgcagtactggagcatttacccattcatgttgagcctcaaatgcttgttttctggggtccacaaaagacagttttatacattttgagttgttcataaagtttgtcttgtgatagtcctggcacttaaagacaaatttttctggtagtaaaagttcagatttattactatgtcatgaaacacagtacattcaaatcaaacggcagttttctttctaagtaaatgatttccagtcatctaaaaggtgggcaagatgagataaagacattttgatacagtaattgttttggttgggttttcatgtcagtttatgtttgactaaagctctcttcatatgcaggtttataaatttgttaggtctgttgtcccatgattaaacatggagtgcctcctctctgatttaatattctgcaggtcattgtaacctgctaggcaaagtcacaacattgcattaaagaggtgatagctttgctaatatcactgttttaaaggacgtacagttaaaggaatattaagtgggagaaagcctacaaggcttttagaatattatcagtatcttcatttctggtattcagatgttatgtgataaaacacattttttttggctttcccagatacactatatatttgttcaagggtaaatctataaaatgtatatactttattttgtggttttgctatttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaacagctatcgaaagttagcacagcttgtctgtggtgctgtttttttccccactgcagtggacttatgctgttttcatgtttagaaacaaaaaggtttcatgtgattcatgtgtaagatgcacagtatttgacatcctgattatgtaatccctattccatctatccagtcttacacttatggttggcctcaaatctattgcatttatgataatgtattatatctagttgagtttaatatttttttattagcctgtaaataaagatggcatcttctacattaaaatgatattgatctcatttttttaaataaacattttgtttccttgacgttaaa

SEQ ID NO: 138381 - DNA, 4460 bp, Homo sapiens
  Payload ID: 7102
  Gene Symbol: GOPC
  Gene Name: golgi-associated PDZ and coiled-coil motif containing
  ENST ID: ENST00000535237
  CDS Start-End: 255-1478
acgcatgcgcagcgggggcaggctgggaggtgggactgactgagtcttccgtgtgtcgccgccgttgccgcctcagcttcagcctcgttactcctgcggttctgtgactgtgctgctggcgttaacggcgcgaggtgaagggaggtgacggagtgtgcccgcgcgcgcgggggtcccctcagtcccagcagttcccttcgtgcgcggggggcggcgagggtcttcagcagtcgggagaggcccttgacggcgccatgtcggcgggcggtccatgcccagcagcagccggagggggcccagggggcgcctcctgctccgtgggggcccctggcggggtatccatgttccggtggctggaggtgctggagaaggagttcgacaaagcttttgtggatgtggatctgctcctgggagagatcgatccagaccaagcggacatcacttatgaggggcgacagaagatgaccagcctgagctcctgctttgcacagctttgccacaaagcccagtctgtgtctcaaatcaaccacaagctggaggcacagttggtggatctgaaatctgaactgacagaaacccaagcagagaaagttgttttggagaaagaagtacatgatcagcttttacagctgcactctattcagctgcagcttcatgctaaaactggtcaaagtgctgactctggtaccattaaggcaaaattgtctggcccctctgtggaggagctggaaagagagcttgaggcaaacaaaaaagaaaaaatgaaagaagcacaacttgaagctgaagtgaaattgttgagaaaagagaatgaagcccttcgtagacatatagctgttctccaggctgaagtatatggggcgagactagctgccaagtacttggataaggaactggcaggaagggtccaacagatacaattgctaggacgagatatgaagggacctgctcatgataagctttggaaccaattagaagctgaaatacatttgcatcgtcacaaaactgtgatccgagcctgcagaggacgtaatgacttgaaacgaccaatgcaagcaccaccaggccatgatcaagattccctaaagaaaagccaaggtgttggtccaattagaaaagttctcctccttaaggaagatcatgaaggccttggcatttcaattacaagaggagagattgaatttgaagtagtttatgtggctcctgaagtggattctgatgatgaaaacgtagagtatgaagatgagagtggacatcgttaccgtttgtaccttgatgagttagaaggaggtggtaaccctggtgctagttgcaaagacacaagtggggaaatcaaagtattacaaggatttaataagaaggcagtaactgacacacatgaaaatggagacctgggcactgcaagtgaaactccgctagatgacggtgcttcaaaattagatgatctgcacactctgtatcataaaaaatcttattaaattgaccatatctccagacaagattgttaatcagactattctgaatttggggcactggggaagatggtgacaaagactacaaaatcaggggaggctgtttgttgcctaaatgaaaggcgggtacctcagggcttcatgtgaacaattctcaatgcataaaacaccctgttttctgtggtagaccataattagctattgcatgtaaagcaattttgattttcttgaacttgtaagcaccaaagcatgtgtttcccaaaggggtattactgggctcttaagtaccaaatgaaaccctactgttttacttggttccttttccctttagtaggaggacagtgctaactggaattttataaggagtaccctttaaaatacagagagtaagtgaattcatattttatattctagaatgttaactgtggtatttcagaagacagagcttgactcaatgaattgtagaaatataggcttgacttaatttttgtaactgaaaggctttagacttaaaaaaatttattgtgcatcctaaaatctaaaccaattattaatgatcatttattgtaatgagtttgcatttcagctttattcaatgcagtacaaaatagttttctttaagcagtcttttatcaatcaatgctgcactagaaatagattctcaaaagttactaaacattttactttttttgttttttaaaagaaatgcagatgagtgtaaaacatctgttctcaattatgttgatctgtgtgcgcagtactggagcatttacccattcatgttgagcctcaaatgcttgttttctggggtccacaaaagacagttttatacattttgagttgttcataaagtttgtcttgtgatagtcctggcacttaaagacaaatttttctggtagtaaaagttcagatttattactatgtcatgaaacacagtacattcaaatcaaacggcagttttctttctaagtaaatgatttccagtcatctaaaaggtgggcaagatgagataaagacattttgatacagtaattgttttggttgggttttcatgtcagtttatgtttgactaaagctctcttcatatgcaggtttataaatttgttaggtctgttgtcccatgattaaacatggagtgcctcctctctgatttaatattctgcaggtcattgtaacctgctaggcaaagtcacaacattgcattaaagaggtgatagctttgctaatatcactgttttaaaggacgtacagttaaaggaatattaagtgggagaaagcctacaaggcttttagaatattatcagtatcttcatttctggtattcagatgttatgtgataaaacacattttttttggctttcccagatacactatatatttgttcaagggtaaatctataaaatgtatatactttattttgtggttttgctatttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaacagctatcgaaagttagcacagcttgtctgtggtgctgtttttttccccactgcagtggacttatgctgttttcatgtttagaaacaaaaaggtttcatgtgattcatgtgtaagatgcacagtatttgacatcctgattatgtaatccctattccatctatccagtcttacacttatggttggcctcaaatctattgcatttatgataatgtattatatctagttgagtttaatatttttttattagcctgtaaataaagatggcatcttctacattaaaatgatattgatctcatttttttaaataaacattttgtttccttgacgtt

SEQ ID NO: 138382 - DNA, 2528 bp, Homo sapiens
  Payload ID: 7103
  Gene Symbol: GGA1
  Gene Name: golgi-associated, gamma adaptin ear containing, ARF binding protein 1
  Uniprot ID: Q9UJY5
  ENST ID: ENST00000325180
  CDS Start-End: 17-1675
tgggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttaggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgga

SEQ ID NO: 138383 - DNA, 3159 bp, Homo sapiens
  Payload ID: 7103
  Gene Symbol: GGA1
  Gene Name: golgi-associated, gamma adaptin ear containing, ARF binding protein 1
  Uniprot ID: Q9UJY5
  ENST ID: ENST00000343632
  CDS Start-End: 387-2306
gaagtggcctcagagcccctcagcaacatgcccgcagagaattcttccggaggcggtcacagacatctccgtgacgcagaacgagttagagcgtcccttggggtttccatggtgctgcccttagcctgcagtatctccacttcctctcccgcctgagcgccgggaacggaaaagcaggcggccggtcccagctgcgacgtagacgccgcgtgggggtggggttgggcgagtaggtgacgctctaggcgagctcgttggcctctctatggtgccgagcgcgcccgttcggacgttgcccctttaatcggcagagggcggtgcccaggaggtcccgcgagagctgcggggggcgggggggcggtgccgaggctgggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgga

SEQ ID NO: 138384 - DNA, 2107 bp, Homo sapiens
  Payload ID: 7103
  Gene Symbol: GGA1
  Gene Name: golgi-associated, gamma adaptin ear containing, ARF binding protein 1
  Uniprot ID: Q9UJY5
  ENST ID: ENST00000381756
  CDS Start-End: 137-2107
ctcgttggcctctctatggtgccgagcgcgcccgttcggacgttgcccctttaatcggcagagggcggtgcccaggaggtcccgcgagagctgcggggggcgggggggcggtgccgaggctgggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgagaaggggagaggccaccatccgtcccccgccatgtgacgacaccaaggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctag

SEQ ID NO: 138385 - DNA, 575 bp, Homo sapiens
  Payload ID: 7103
  Gene Symbol: GGA1
  Gene Name: golgi-associated, gamma adaptin ear containing, ARF binding protein 1
  ENST ID: ENST00000405147
  CDS Start-End: 28-345
ggtgccgaggctgggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaaggggactctgctgtgagagccactttccccagcccagtttgctgctaggagacggagagtaggcccagggcctcccagttccaccctcacccctccctgggcagcctggagacctctggctcctctttcctgggatgtcaaggctaagtccccagagccgactatgagcaggcctgtccctcatgtcagttctgcatcctcaccatggtgccatctagcaggtggggaaacagacactgagggctg

SEQ ID NO: 138386 - DNA, 3205 bp, Homo sapiens
  Payload ID: 7103
  Gene Symbol: GGA1
  Gene Name: golgi-associated, gamma adaptin ear containing, ARF binding protein 1
  Uniprot ID: Q9UJY5
  ENST ID: ENST00000406772
  CDS Start-End: 653-2353
agtcggcccctcagaccctggagcgatggaggaccccggccccggcgcggtccagcggtgggagcgggcgccgcccacctgtcggatccctgggccatgacccctgggacggcgagtgagctgcgccgggaacccccgggacggagagagcagcctccaacccccaaggctcacattgcttcacggagtagcggcccggggaaggagcacgcgagcggttccccggggttgcatctcacacccgggagggagggaccctactattttcaggccccgaatcctccactctctggccctgcatggcgttcctggagcccgtgtggacatgagtggctgggatgcagtgccgtagcaggctgggggacacaaaagagaactgacccagcactgctaccctgggcaggagtagaggattagagaaggggacaccggagccactcccaagggaatgaaggctttctgaacctggtgtgatgatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgg

SEQ ID NO: 138387 - DNA, 927 bp, Homo sapiens
  Payload ID: 7103
  Gene Symbol: GGA1
  Gene Name: golgi-associated, gamma adaptin ear containing, ARF binding protein 1
  ENST ID: ENST00000449944
  CDS Start-End: 189-927
ggggcacgaggcgggccccttcccggcgggggcggggtacgggtcgccccctcctcacgccccgcccccggcccgggaggggcggtgtcctcagtcggcccctcagaccctggagcgatggaggaccccggccccggcgcggtccagcggtgggagcgggcgccgcccacctgtcggatccctgggccatgacccctgggacggcgaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagc

SEQ ID NO: 138388 - DNA, 483 bp, Homo sapiens
  Payload ID: 7103
  Gene Symbol: GGA1
  Gene Name: golgi-associated, gamma adaptin ear containing, ARF binding protein 1
  ENST ID: ENST00000431745
  CDS Start-End: 431-483
gagcgatggaggaccccggccccggcgcggtccagcggtgggagcgggcgccgcccacctgtcggatccctgggccatgacccctgggacggcgagtgtggacatgagtggctgggatgcagtgccgtagcaggctgggggacacaaaagagaactgacccagcactgctaccctgggcaggagtagaggattagagaaggggacaccggagccactcccaagggaatgaaggctttctgaacctggtgtgatgatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttct

SEQ ID NO: 138389 - DNA, 661 bp, Homo sapiens
  Payload ID: 7103
  Gene Symbol: GGA1
  Gene Name: golgi-associated, gamma adaptin ear containing, ARF binding protein 1
  ENST ID: ENST00000411501
  CDS Start-End: 540-661
gggccccttcccggcgggggcggggtacgggtcgccccctcctcacgccccgcccccggcccgggaggggcggtgtcctcagtcggcccctcagaccctggagcgatggaggaccccggccccggcgcggtccagcggtgggagcgggcgccgcccacctgtcggatccctgggccatgacccctgggacggcgagggagacaggtgtggacatgagtggctgggatgcagtgccgtagcaggctgggggacacaaaagagaactgacccagcactgctaccctgggcaggagtagaggattagagaaggggacaccggagccactcccaagggaatgaaggctttctgaacctggtgtgatgatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaa

SEQ ID NO: 138390 - DNA, 946 bp, Homo sapiens
  Payload ID: 7103
  Gene Symbol: GGA1
  Gene Name: golgi-associated, gamma adaptin ear containing, ARF binding protein 1
  ENST ID: ENST00000326597
  CDS Start-End: 833-946
ccaaggtgggcggatcacaaggtcaggagattgagaccatcctggctaacatggtgaaaccctgtctctactaaaaatacaaaaaaaaattagccgggcgtggtggcgggtgcctgtagtcccagctactcgggaggctgaggaaggagaatggcatgaacctgggaggcggagcttgcagtgagccgagatcgtgccactgcactccagcctgggcaacagcgtgagactcgtctcaaaaaaaaaaaaaaatccatatttcattccagctttacaagatggggaaatggaggttcagggaagcatgtaagctagattgttgtttaaccagtattgggggttaaaggggtagctgtctggtcgtgtttacaccacttcatgtagacctgttggccctctttccttgccactatccatttctggattcagtcttccccagaacctcaccctttgcctgccctcagctgactgctcattcatttgccaaggggagacaggtgtggacatgagtggctgggatgcagtgccgtagcaggctgggggacacaaaagagaactgacccagcactgctaccctgggcaggagtagaggattagagaaggggacaccggagccactcccaagggaatgaaggctttctgaacctggtgtgatgatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtg

SEQ ID NO: 138391 - DNA, 566 bp, Homo sapiens
  Payload ID: 7103
  Gene Symbol: GGA1
  Gene Name: golgi-associated, gamma adaptin ear containing, ARF binding protein 1
  ENST ID: ENST00000429218
  CDS Start-End: 242-566
gtgccgaggctgggggccggtggcggatggagcccgcgatggagccggagactctggaggcgcgaatcaagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgc

SEQ ID NO: 138392 - DNA, 568 bp, Homo sapiens
  Payload ID: 7103
  Gene Symbol: GGA1
  Gene Name: golgi-associated, gamma adaptin ear containing, ARF binding protein 1
  ENST ID: ENST00000439161
  CDS Start-End: 390-568
ggaaccggaaccgggggcacgaggcgggccccttcccggcgggggcggggggagacaggtgtggacatgagtggctgggatgcagtgccgtagcaggctgggggacacaaaagagaactgacccagcactgctaccctgggcaggagtagaggattagagaaggggacaccggagccactcccaagggaatgaaggctttctgaacctggtgtgatgagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgc

SEQ ID NO: 138393 - DNA, 565 bp, Homo sapiens
  Payload ID: 7103
  Gene Symbol: GGA1
  Gene Name: golgi-associated, gamma adaptin ear containing, ARF binding protein 1
  ENST ID: ENST00000413251
  CDS Start-End: 240-565
ctctaaaagtggggccctttggagggcagctgtgctcatctgtctgtctacacccacaatcagatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgct

SEQ ID NO: 138394 - DNA, 577 bp, Homo sapiens
  Payload ID: 7103
  Gene Symbol: GGA1
  Gene Name: golgi-associated, gamma adaptin ear containing, ARF binding protein 1
  ENST ID: ENST00000447515
  CDS Start-End: 494-577
agtcggcccctcagaccctggagcgatggaggaccccggccccggcgcggtccagcggtgggagcgggcgccgcccacctgtcggatccctgggccatgacccctgggacggcgagtgagctgcgccgggaacccccgggacggagagagcagcctccaacccccaaggctcacattgcttcacggagtagcggcccggggaaggagcacgcgagcggttccccggggttgcatctcacacccgggagggagggaccctactattttcaggccccgaatcctccactctctggccctgcatggcgttcctggagcccatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaag

SEQ ID NO: 138395 - DNA, 559 bp, Homo sapiens
  Payload ID: 7103
  Gene Symbol: GGA1
  Gene Name: golgi-associated, gamma adaptin ear containing, ARF binding protein 1
  ENST ID: ENST00000423024
  CDS Start-End: 234-559
gtggaagagcaggaatcccactgccgggccacaatgaccccagctctcctcttccagatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgct

SEQ ID NO: 138396 - DNA, 639 bp, Homo sapiens
  Payload ID: 7103
  Gene Symbol: GGA1
  Gene Name: golgi-associated, gamma adaptin ear containing, ARF binding protein 1
  ENST ID: ENST00000453208
  CDS Start-End: 428-639
gggcggggtacgggtcgccccctcctcacgccccgcccccggcccgggaggggcggtgtcctcagtcggcccctcagaccctggagcgatggaggaccccggccccggcgcggtccagcggtgggagcgggcgccgcccacctgtcggatccctgggccatgacccctgggacggcgagagtagaggattagagaaggggacaccggagccactcccaagggaatgaaggctttctgaacctggtgtgatgatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggat

SEQ ID NO: 138397 - DNA, 5973 bp, Homo sapiens
  Payload ID: 7104
  Gene Symbol: GGA2
  Gene Name: golgi-associated, gamma adaptin ear containing, ARF binding protein 2
  Uniprot ID: Q9UJY4
  ENST ID: ENST00000309859
  CDS Start-End: 84-1925
gcagtcagcagaggagagcgccaggacgctacagcggctgaagaggcagtggcgcccgcggccgcagcgtcggggctggagcgatggcggcgaccgcggtggcggcggctgtggcgggaaccgagtcggcccagggtcccccgggcccggcagcgtcgctggagctgtggctcaacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacggtgctggagatgtgcatgaaccactgtggggagaagttccacagcgaggtggccaaatttcgtttcctgaacgaactgatcaaagtgttgtccccaaagtacctggggtcctgggccacaggaaaagttaaaggaagagtcattgaaatactcttcagttggacagtctggtttccggaagacatcaagattcgagacgcttatcagatgctgaagaaacaaggaattataaaacaagaccctaaactaccagtggataaaatcttacccccaccatctccctggcccaagagctccatctttgatgctgatgaagaaaagtccaagcttctgacaaggcttctaaagagcaaccaccccgaggaccttcaggctgcaaaccggttaatcaagaatttggtcaaggaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcagcacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgtgttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactgtggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatctcagctcactgcaatctctgcctaccaggttcaagcgattctcgtgcctcagcctctcgagtagctgggactacaggcgtgagccagcacgcccagctaatttttgtatttttagtagagacaggatttcaccatgttggccaggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctataatcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccctgataatgccatgttttgtcctaaccttttgctgcagttaattactcttcctattatcttccatgaacttaagactgggcaaaaatgtttccttatctgtgagccactctgaacacaaacaggtcatgaagatagtgttgaaaacaataaatgacaaccaaaagaaaagtgaatattacctagtacaaatagtgtaaattgagacagaaaatgttaaagctagaaagcaagggcaatattctagaatacaaatagtgcttgcctactacaatattaatcccaaatcctttaaatatacccattatagaagatgcttacccagcgtcaagagtataaaagtgggtttgtttgttttcttgagacagggctttgctctgttgcccaggctggagtgcagtggcgtgattgtagctcaatgcagccttgaattcctgtgttcaggcgatcctccggcttcagcctctggagtagctgggactacaggtgcatgctgccacgcccagctaatgttgcagtttttcgtaaagactggatctctgtgttacccaggctggtctcctgggctcaagcagtcctcctgccttgacctcccaaagtgctgggattacaggcatgagccaccatgtcctgaccccagtttgttttaaagccaagcgatgcaccaagatgtttgtgtgcacatctgacagtggtaatctttgggtcagggaattatagataaattttctttaaattttttctgagctttctaaaatcagctgaaaataaaaccttattttttta

SEQ ID NO: 138398 - DNA, 1713 bp, Homo sapiens
  Payload ID: 7104
  Gene Symbol: GGA2
  Gene Name: golgi-associated, gamma adaptin ear containing, ARF binding protein 2
  ENST ID: ENST00000567468
  CDS Start-End: 14-685
cggggctggagcgatggcggcgaccgcggtggcggcggctgtggcgggaaccgagtcggcccagggtcccccgggcccggcagcgtcgctggagctgtggctcaacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacggtgctggagatgtgcatgaaccactgtggggagaagttccacagcgaggtggccaaatttcgtttcctgaacgaactgatcaaagtgttgtccccaaagtacctggggtcctgggccacaggaaaagttaaaggaagagtcattgaaatactcttcagttggacagtctggtttccggaagacatcaagattcgagacgcttatcagatgctgaagaaacaaggaattataaaacaagaccctaaactaccagtggataaaatcttacccccaccatctccctggcccaagagctccatctttgatgctgatgaagaaaagtccaagcttctgacaaggcttctaaagagcaaccaccccgaggaccttcaggctgctgtcctgaaagtggctgtggtttatggcatcactcccttctaatcagcaagtccagtggccacttagagcccagctcctacctcttcattcacttaacaagtagttattggctgtgcacagtggctcacgcctataatcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccctg

SEQ ID NO: 138399 - DNA, 563 bp, Homo sapiens
  Payload ID: 7104
  Gene Symbol: GGA2
  Gene Name: golgi-associated, gamma adaptin ear containing, ARF binding protein 2
  ENST ID: ENST00000570111
  CDS Start-End: 54-233
acagcggctgaagaggcagtggcgcccgcggccgcagcgtcggggctggagcgatggcggcgaccgcggtggcggcggctgtggcgggaaccgagtcggcccagggtcccccgggcccggcagcgtcgctggagctgtggctcaacaaagccacagacccaagcatgtcggaacaggattggtcagctatccagaatttctgtgagcaggtgaacactgaccccaatgggtaagccccacacatgcgccctggctactggcccacaagatccagtctccgcaagagaaggaagctctttatgccttaacggtgctggagatgtgcatgaaccactgtggggagaagttccacagcgaggtggccaaatttcgtttcctgaacgaactgatcaaagtgttgtccccaaagtacctggggtcctgggccacaggaaaagttaaaggaagagtcattgaaatactcttcagttggacagtctggtttccggaagacatcaagattcgagacgcttatcagatgctgaagaaacaaggaattataaaacaagaccctaaactaccag

SEQ ID NO: 138400 - DNA, 366 bp, Homo sapiens
  Payload ID: 7104
  Gene Symbol: GGA2
  Gene Name: golgi-associated, gamma adaptin ear containing, ARF binding protein 2
  ENST ID: ENST00000563047
  CDS Start-End: 14-163
cggggctggagcgatggcggcgaccgcggtggcggcggctgtggcgggaaccgagtcggcccagggtcccccgggcccggcagcgtcgctggagctgtggctcagtgaccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacggtgagtgctggagatgtgcatgaaccactgtggggagaagttccacagcgaggtggccaaatttcgtttcctgaacgaactgatcaaagtgttgtccccaaag

SEQ ID NO: 138401 - DNA, 572 bp, Homo sapiens
  Payload ID: 7104
  Gene Symbol: GGA2
  Gene Name: golgi-associated, gamma adaptin ear containing, ARF binding protein 2
  ENST ID: ENST00000569300
  CDS Start-End: 196-572
ttttctgttacagatatggaaaccgaggttctgaaaagttaactaaaacttccgaggttatagtacgaggcaaaaccaagatttaaactcagatctgtgccgatccagagtccaagcttaactctgatctactgagtgttgtcagagcatctgtttctaagacattaagaatggttaaaaggagcttcttggctcatggtcaagctgcctttctctttatctctgcagttggccaacagctgccctagccctgaagacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacggtgctggagatgtgcatgaaccactgtggggagaagttccacagcgaggtggccaaatttcgtttcctgaacgaactgatcaaagtgttgtccccaaagtacctggggtcctgggccacaggaaaagttaaaggaagagtcattgaaatactctt

SEQ ID NO: 138402 - DNA, 553 bp, Homo sapiens
  Payload ID: 7104
  Gene Symbol: GGA2
  Gene Name: golgi-associated, gamma adaptin ear containing, ARF binding protein 2
  ENST ID: ENST00000563494
  CDS Start-End: 82-261
agtcagcagaggagagcgccaggacgctacagcggctgaagaggcagtggcgcccgcggccgcagcgtcggggctggagcgatggcggcgaccgcggtggcggcggctgtggcgggaaccgagtcggcccagggtcccccgggcccggcagcgtcgctggagctgtggctcaacaaagccacagacccaagcatgtcggaacaggattggtcagctatccagaatttctgtgagcaggtgaacactgaccccaatgggtaagccccacacatgcgccctggctactggcccacaagatccagtctccgcaagagaaggaagctctttatgccttaacggtgctggagatgtgcatgaaccactgtggggagaagttccacagcgaggtggccaaatttcgtttcctgaacgaactgatcaaagtgttgtccccaaagtacctggggtcctgggccacaggaaaagttaaaggaagagtcattgaaatactcttcagttggacagtctggtttccggaagacatcaagattcgagacgcttatcagatgctgaa

SEQ ID NO: 138403 - DNA, 387 bp, Homo sapiens
  Payload ID: 7104
  Gene Symbol: GGA2
  Gene Name: golgi-associated, gamma adaptin ear containing, ARF binding protein 2
  ENST ID: ENST00000562117
  CDS Start-End: 1-387
cggctgtggcgggaaccgagtcggcccagggtcccccgggcccggcagcgtcgctggagctgtggctcaacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacgtgtcctcataggcttgaggcagggttagccttggttccagcgcagtctccagcaagtgattaccagcctggaggggagcctgggaccactggctttccaccttctcctgggggtcctgtgtctgtgcaggtgctggagatgtgcatgaaccactgtg

SEQ ID NO: 138404 - DNA, 388 bp, Homo sapiens
  Payload ID: 7104
  Gene Symbol: GGA2
  Gene Name: golgi-associated, gamma adaptin ear containing, ARF binding protein 2
  ENST ID: ENST00000562944
  CDS Start-End: 38-388
cagtggcgcccgcggccgcagcgtcggggctggagcgatggcggcgaccgcggtggcggcggctgtggcgggaaccgagtcggcccagggtcccccgggcccggcagcgtcgctggagctgtggctcaacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacgcctggaggggagcctgggaccactggctttccaccttctcctgggggtcctgtgtctgtgcaggtgctggagatgtgcatgaaccactgtggggagaag

SEQ ID NO: 138405 - DNA, 586 bp, Homo sapiens
  Payload ID: 7104
  Gene Symbol: GGA2
  Gene Name: golgi-associated, gamma adaptin ear containing, ARF binding protein 2
  ENST ID: ENST00000569189
  CDS Start-End: 78-257
agcagaggagagcgccaggacgctacagcggctgaagaggcagtggcgcccgcggccgcagcgtcggggctggagcgatggcggcgaccgcggtggcggcggctgtggcgggaaccgagtcggcccagggtcccccgggcccggcagcgtcgctggagctgtggctcaacaaagccacagacccaagcatgtcggaacaggattggtcagctatccagaatttctgtgagcaggtgaacactgaccccaatgggtaagccccacacatgcgccctggctactggcccacaagatccagtctccgcaagagaaggaagctctttatgccttaacgtgtcctcataggcttgaggcagggttagccttggttccagcgcagtctccagcaagtgattaccagcctggaggggagcctgggaccactggctttccaccttctcctgggggtcctgtgtctgtgcaggtgctggagatgtgcatgaaccactgtggggagaagttccacagcgaggtggccaaatttcgtttcctgaacgaactgatcaaagtgttgtccccaaagtacctggggtcctgggccacagga

SEQ ID NO: 138406 - DNA, 4069 bp, Homo sapiens
  Payload ID: 7105
  Gene Symbol: GGA3
  Gene Name: golgi-associated, gamma adaptin ear containing, ARF binding protein 3
  Uniprot ID: Q9NZ52
  ENST ID: ENST00000537686
  CDS Start-End: 218-2389
gcgtttctctccactgatctggacgttagagtttttcactccggggtccaaaggggagcgccaaaaggaaacccttgccctccctgtatccgtcgcagtctggcgcggccctcggtgacggcactcactcctctcaggaccccatgcaggccccgccccgtctcagctcgtgcagactctcgcgagttttgaagccgcggggccgggcggctgcaatatggcggaggcggaaggggaaagcctggagtcctggctcaataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaagtggggaagttccgctttttgaatgagttaatcaaagtcgtctctccaaagtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccaggcctcaggacctccacggagccgctcctctagccaggccgaggccaccctggggcccagcagcacaagcaacgccctctcctggctggacgaggagctactctgcttgggcctcgccgacccagcccctaatgttcctcccaaagagtcagctgggaacagccagtggcacctgctccagagggaacagtccgacctggacttcttcagccccaggccggggaccgctgcctgtggcgcctccgatgctcctctgctccagccctcagccccctcctcaagcagctcccaagctccactgccgcctcccttcccagctcctgtggtcccagccagtgttcctgcccccagtgcgggctcctccttgttttctactggagtggccccagccttggccccaaaagttgagcccgcagtccctgggcaccatggcttggcgttgggcaacagcgcgctgcaccacctggatgccctcgatcagcttctagaagaggccaaagtgacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagccaggcaggctgccctgagacgaggagggctctggtcccgtcactctccatgccctgacaacagtgcttgtagctttgatgtggaacaggggccctgggcatttctgctgagaaccaaactgctgctgtgataacctctcctttggcccctaaaaggacctgtttttatctacctgtgtgacttgaagtggccatatgctgtcaggggtgcggagtggcccctgacttcactgctgtcccgggaacatggacccccaggcttggcgtaggtgtttgcttccttctactggcattcactgaagccactggggtggggggtggggggtgggagtctctaaagagagactgtcatgggtcattccccacaagagccacatcctcacacctgacagatgcacggcccaaggggctgcagccctgttgcaattccatgcttcccccgccaaccagctcctgctgccatccccagggaggtggcccaggaaggtgcctggcccagaataaggaactggcatactgcaaagtccccagccctgcctctggtggacagcatcgtcctggaatggccacggagtgatgagttgtgtgcttgtccctggcagtggcaggctgtgtcctatggacatcttggcaggacatggaatttggcctcatgacaggcccaactagggataggaaggaaaatgaagagagccagtatttccccttctccagaagcaggtactcagctttctgggaaaagcgtgcctccagccgtggggacaggccatcctactgactacctcttgcttggcatgaaataaactgctatcctccccttggaatctaccgccactctacatcctactgctttggcctccctctcctctcaccagatggcatgtggtgtggcacctgtggctggacacaggaggcctcaggatcacaaatgttacactagacatatgtcctaatgtgctgcccagaaacctcaactgttccccagctactgaggggcactgtcagcgagatgttgggtctggaggtgatgagatcgggccacacttgagctgagtcaccagaccctattgcttcaacagtgcttggcccccgccagcttgtcccagccactctagctgctggatgtgatcctgggacatgtactccaagcctccgtcacaaaaaaaaaatcaccagctgccatagacacgggggaagcttgcggagcccaggtgaacaagctcagcaatcggacatctctggggaaaggaaggtggcacagaccatgttccctggttcctccctgccccttgccaggcttccttattccttactatgggaagaggtcatatcccttccctgcccctcgctgtctttagcaagcaggtttcactgcttcattagaagaggacaagtcaaaagtgaatcatttttcactacttaaggaataaatccaagagctttccagagactggctgctgcagccctgggaatgtctgtggaattactatgtggaaatggaactttgtgttatgctctagacattacagttatttgagtgttactcgttactgttgaggtcagtgcttcgtggcaaatggctgtactggatatcccagctctgctgcccttgttttgctgcatgttaaataaaaccattttcactgta

SEQ ID NO: 138407 - DNA, 3766 bp, Homo sapiens
  Payload ID: 7105
  Gene Symbol: GGA3
  Gene Name: golgi-associated, gamma adaptin ear containing, ARF binding protein 3
  Uniprot ID: Q9NZ52
  ENST ID: ENST00000538886
  CDS Start-End: 14-2086
gggcggctgcaatatggcggaggcggaaggggaaagcctggagtcctggctcaataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacgtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccaggcctcaggacctccacggagccgctcctctagccaggccgaggccaccctggggcccagcagcacaagcaacgccctctcctggctggacgaggagctactctgcttgggcctcgccgacccagcccctaatgttcctcccaaagagtcagctgggaacagccagtggcacctgctccagagggaacagtccgacctggacttcttcagccccaggccggggaccgctgcctgtggcgcctccgatgctcctctgctccagccctcagccccctcctcaagcagctcccaagctccactgccgcctcccttcccagctcctgtggtcccagccagtgttcctgcccccagtgcgggctcctccttgttttctactggagtggccccagccttggccccaaaagttgagcccgcagtccctgggcaccatggcttggcgttgggcaacagcgcgctgcaccacctggatgccctcgatcagcttctagaagaggccaaagtgacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagccaggcaggctgccctgagacgaggagggctctggtcccgtcactctccatgccctgacaacagtgcttgtagctttgatgtggaacaggggccctgggcatttctgctgagaaccaaactgctgctgtgataacctctcctttggcccctaaaaggacctgtttttatctacctgtgtgacttgaagtggccatatgctgtcaggggtgcggagtggcccctgacttcactgctgtcccgggaacatggacccccaggcttggcgtaggtgtttgcttccttctactggcattcactgaagccactggggtggggggtggggggtgggagtctctaaagagagactgtcatgggtcattccccacaagagccacatcctcacacctgacagatgcacggcccaaggggctgcagccctgttgcaattccatgcttcccccgccaaccagctcctgctgccatccccagggaggtggcccaggaaggtgcctggcccagaataaggaactggcatactgcaaagtccccagccctgcctctggtggacagcatcgtcctggaatggccacggagtgatgagttgtgtgcttgtccctggcagtggcaggctgtgtcctatggacatcttggcaggacatggaatttggcctcatgacaggcccaactagggataggaaggaaaatgaagagagccagtatttccccttctccagaagcaggtactcagctttctgggaaaagcgtgcctccagccgtggggacaggccatcctactgactacctcttgcttggcatgaaataaactgctatcctccccttggaatctaccgccactctacatcctactgctttggcctccctctcctctcaccagatggcatgtggtgtggcacctgtggctggacacaggaggcctcaggatcacaaatgttacactagacatatgtcctaatgtgctgcccagaaacctcaactgttccccagctactgaggggcactgtcagcgagatgttgggtctggaggtgatgagatcgggccacacttgagctgagtcaccagaccctattgcttcaacagtgcttggcccccgccagcttgtcccagccactctagctgctggatgtgatcctgggacatgtactccaagcctccgtcacaaaaaaaaaatcaccagctgccatagacacgggggaagcttgcggagcccaggtgaacaagctcagcaatcggacatctctggggaaaggaaggtggcacagaccatgttccctggttcctccctgccccttgccaggcttccttattccttactatgggaagaggtcatatcccttccctgcccctcgctgtctttagcaagcaggtttcactgcttcattagaagaggacaagtcaaaagtgaatcatttttcactacttaaggaataaatccaagagctttccagagactggctgctgcagccctgggaatgtctgtggaattactatgtggaaatggaactttgtgttatgctctagacattacagttatttgagtgttactcgttactgttgaggtcagtgcttcgtggcaaatggctgtactggatatcccagctctgctgcccttgttttgctgcatgttaaataaaaccattttcactgta

SEQ ID NO: 138408 - DNA, 547 bp, Homo sapiens
  Payload ID: 7105
  Gene Symbol: GGA3
  Gene Name: golgi-associated, gamma adaptin ear containing, ARF binding protein 3
  ENST ID: ENST00000577435
  CDS Start-End: 31-240
tttgaagccgcggggccgggcggctgcaatatggcggaggcggaaggggaaagcctggagtcctggctcaccacaacagaaacactgccggggaggccgagccccgacctgggaagcagggtgatacactgggtgccacgggccttccctctgcctggcagctgtcgctactcagatccctgcagccctgttgccagtgaaggagctggagtctctgttatgatgtgttcatccagctgataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacgtacctgggggacagggtgtctgagaaagtgaagaccaaggttattgagctgctgtacagctggaccatggccctgccagaagaagcaaagatcaaagacgcctaccacatgctgaagagacaggcttttagccaagctgctgaaaag

SEQ ID NO: 138409 - DNA, 2255 bp, Homo sapiens
  Payload ID: 7105
  Gene Symbol: GGA3
  Gene Name: golgi-associated, gamma adaptin ear containing, ARF binding protein 3
  Uniprot ID: Q9NZ52
  ENST ID: ENST00000582717
  CDS Start-End: 259-2214
acaacaattcaggcccttgtcccaagtaggaggacattccccaagcaggcgggtaaagtctcctcctggtcaagtgctaacgataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaagtggggaagttccgctttttgaatgagttaatcaaagtcgtctctccaaagtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccaggcctcaggacctccacggagccgctcctctagccaggccgaggccaccctggggcccagcagcacaagcaacgccctctcctggctggacgaggagctactctgcttgggcctcgccgacccagcccctaatgttcctcccaaagagtcagctgggaacagccagtggcacctgctccagagggaacagtccgacctggacttcttcagccccaggccggggaccgctgcctgtggcgcctccgatgctcctctgctccagccctcagccccctcctcaagcagctcccaagctccactgccgcctcccttcccagctcctgtggtcccagccagtgttcctgcccccagtgcgggctcctccttgttttctactggagtggccccagccttggccccaaaagttgagcccgcagtccctgggcaccatggcttggcgttgggcaacagcgcgctgcaccacctggatgccctcgatcagcttctagaagaggccaaagtgacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagccaggcagg

SEQ ID NO: 138410 - DNA, 598 bp, Homo sapiens
  Payload ID: 7105
  Gene Symbol: GGA3
  Gene Name: golgi-associated, gamma adaptin ear containing, ARF binding protein 3
  ENST ID: ENST00000584550
  CDS Start-End: 1-194
cctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagccaggcaggctgccctgagacgaggagggctctggtcccgtcactctccatgccctgacaacagtgct

SEQ ID NO: 138411 - DNA, 521 bp, Homo sapiens
  Payload ID: 7105
  Gene Symbol: GGA3
  Gene Name: golgi-associated, gamma adaptin ear containing, ARF binding protein 3
  ENST ID: ENST00000580799
  CDS Start-End: 113-521
tgcaatatggcggaggcggaaggggaaagcctggagtcctggctcatacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaaga

SEQ ID NO: 138412 - DNA, 2319 bp, Homo sapiens
  Payload ID: 7105
  Gene Symbol: GGA3
  Gene Name: golgi-associated, gamma adaptin ear containing, ARF binding protein 3
  ENST ID: ENST00000582486
  CDS Start-End: 257-2155
aacaattcaggcccttgtcccaagtaggaggacattccccaagcaggcgggtaaagtctcctcctggtcaagtgctaacgataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaagtggggaagttccgctttttgaatgagttaatcaaagtcgtctctccaaagtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccaggcctcaggacctccacggagccgctcctctagccaggccgaggccaccctggggcccagcagcacaagcaacgccctctcctggctggacgaggagctactctgcttgggcctcgccgacccagcccctaatgttcctcccaaagagtcagctgggaacagccagtggcacctgctccagagggaacagtccgacctggacttcttcagccccaggccggggaccgctgcctgtggcgcctccgatgctcctctgctccagccctcagccccctcctcaagcagctcccaagctccactgccgcctcccttcccagctcctgtggtcccagccagtgttcctgcccccagtgcgggctcctccttgttttctactggagtggccccagccttggccccaaaagttgagcccgcagtccctgggcaccatggcttggcgttgggcaacagcgcgctgcaccacctggatgccctcgatcagcttctagaagaggccaaagtgacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaagtggcaggctgtgtcctatggacatcttggcaggacatggaatttggcctcatgacaggcccaactagggataggaaggaaaatgaagagagccagtatttccccttctccagaagcaggtactcagctttctgggaaaagcgtgcctccagccgtggggacaggccatcctactgactacctcttgcttggcatgaaataaactgctatcctcccctt

SEQ ID NO: 138413 - DNA, 550 bp, Homo sapiens
  Payload ID: 7105
  Gene Symbol: GGA3
  Gene Name: golgi-associated, gamma adaptin ear containing, ARF binding protein 3
  ENST ID: ENST00000583282
  CDS Start-End: 1-333
agtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaagctcctgctgccatccccagggaggtggcccaggaaggtgcctggcccagaataaggaactggcatactgcaaagtccccagccctgcctctggtggacagcatcgtcctggaatggccacggagtgatgagttgtgtgcttgtccctggcagtggcaggctgtgtcctatggacatcttggcaggacatggaatttggcctcatgacaggcccaactagggataggaaggaaaatgaagagagccagtatttccccttctccagaagcagg

SEQ ID NO: 138414 - DNA, 2251 bp, Homo sapiens
  Payload ID: 7105
  Gene Symbol: GGA3
  Gene Name: golgi-associated, gamma adaptin ear containing, ARF binding protein 3
  Uniprot ID: Q9NZ52
  ENST ID: ENST00000578348
  CDS Start-End: 308-2086
aacaattcaggcccttgtcccaagtaggaggacattccccaagcaggcgggtaaagtctcctcctggtcaagtgctaacgataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacgtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccaggcctcaggacctccacggagccgctcctctagccaggccgaggccaccctggggcccagcagcacaagcaacgccctctcctggctggacgaggagctactctgcttgggcctcgccgacccagcccctaatgttcctcccaaagagtcagctgggaacagccagtggcacctgctccagagggaacagtccgacctggacttcttcagccccaggccggggaccgctgcctgtggcgcctccgatgctcctctgctccagccctcagccccctcctcaagcagctcccaagctccactgccgcctcccttcccagctcctgtggtcccagccagtgttcctgcccccagtgcgggctcctccttgttttctactggagtggccccagccttggccccaaaagttgagcccgcagtccctgggcaccatggcttggcgttgggcaacagcgcgctgcaccacctggatgccctcgatcagcttctagaagaggccaaagtgacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaagaagcaggtactcagctttctgggaaaagcgtgcctccagccgtggggacaggccatcctactgactacctcttgcttggcatgaaataaactgctatcctccccttggaatctaccgccactctacatcctactgctttggcctccctctcctctcaccagatggcatgtggtgtggcacctgtggctggacacaggaggcctcaggatcacaaatgttacactagacatatgtcctaatgtgctgccc

SEQ ID NO: 138415 - DNA, 432 bp, Homo sapiens
  Payload ID: 7105
  Gene Symbol: GGA3
  Gene Name: golgi-associated, gamma adaptin ear containing, ARF binding protein 3
  ENST ID: ENST00000578773
  CDS Start-End: 1-230
ccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctatcaatgaaagtgaagttgcagccaccttctgggacagaactctctccatttagccccatccagccacctgcagccatcacccaggtcatgttgctggccaatccactgaaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagc

SEQ ID NO: 138416 - DNA, 646 bp, Homo sapiens
  Payload ID: 7105
  Gene Symbol: GGA3
  Gene Name: golgi-associated, gamma adaptin ear containing, ARF binding protein 3
  ENST ID: ENST00000584243
  CDS Start-End: 1-457
ggcggaggcggaaggggaaagcctggagtcctggctcaataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaagtggggaagttccgctttttgaatgagttaatcaaagtcgtctctccaaagtacctgggggacagggtgtctgagaaagtgaagaccaaggttattgagctgctgtacagctggaccatggccctgccagaagaagcaaagatcaaagacgcctaccacatgctgaagagacagggtcttgatcacagggacgtggcccttggtgtatgaggaggggtgacaaggcaaccacagcctgagtgcacgtgctgccatgtcccctttcaggcatagtgcagtctgacccaccaattcctgtggataggacgctgatcccctctccaccacctcgtcccaaaaaccctgtttttgatgatgaggagaagtccaagcttttagccaagctgctgaaaagcaaaa

SEQ ID NO: 138417 - DNA, 551 bp, Homo sapiens
  Payload ID: 7105
  Gene Symbol: GGA3
  Gene Name: golgi-associated, gamma adaptin ear containing, ARF binding protein 3
  ENST ID: ENST00000582376
  CDS Start-End: 7-327
tgcaatatggcggaggcggaaggggaaagcctggagtcctggctcaataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaagtggggaagttccgctttttgaatgagttaatcaaagtcgtctctccaaagagagctaggccctggaggtaacgggatgaccaaacaggccacagggaccggcagctttttctgaagcgccctcagcccaaatctgacagtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtg

SEQ ID NO: 138418 - DNA, 829 bp, Homo sapiens
  Payload ID: 7105
  Gene Symbol: GGA3
  Gene Name: golgi-associated, gamma adaptin ear containing, ARF binding protein 3
  ENST ID: ENST00000580646
  CDS Start-End: 1-475
tctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaaggacctgtttttatctacctgtgtgacttgaagtggccatatgctgtcaggggtgcggagtggcccctgacttcactgctgtcccgggaacatggacccccaggcttggcctcctgctgccatccccagggaggtggcccaggaaggtgcctggcccagaataaggaactggcatactgcaaagtccccagccctgcctctggtggacagcatcgtcctggaatggccacggagtgatgagttgtgtgcttgtccctggcagtggcaggctgtgtcctatggacatcttggcaggacatggaatttggcctcatgacaggcccaactagggataggaaggaaaatgaagagagccagtatttccccttctccagaagcaggtact

SEQ ID NO: 138419 - DNA, 4034 bp, Homo sapiens
  Payload ID: 7105
  Gene Symbol: GGA3
  Gene Name: golgi-associated, gamma adaptin ear containing, ARF binding protein 3
  ENST ID: ENST00000621870
  CDS Start-End: 14-223
gggcggctgcaatatggcggaggcggaaggggaaagcctggagtcctggctcaccacaacagaaacactgccggggaggccgagccccgacctgggaagcagggtgatacactgggtgccacgggccttccctctgcctggcagctgtcgctactcagatccctgcagccctgttgccagtgaaggagctggagtctctgttatgatgtgttcatccagctgataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaagtggggaagttccgctttttgaatgagttaatcaaagtcgtctctccaaagtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccaggcctcaggacctccacggagccgctcctctagccaggccgaggccaccctggggcccagcagcacaagcaacgccctctcctggctggacgaggagctactctgcttgggcctcgccgacccagcccctaatgttcctcccaaagagtcagctgggaacagccagtggcacctgctccagagggaacagtccgacctggacttcttcagccccaggccggggaccgctgcctgtggcgcctccgatgctcctctgctccagccctcagccccctcctcaagcagctcccaagctccactgccgcctcccttcccagctcctgtggtcccagccagtgttcctgcccccagtgcgggctcctccttgttttctactggagtggccccagccttggccccaaaagttgagcccgcagtccctgggcaccatggcttggcgttgggcaacagcgcgctgcaccacctggatgccctcgatcagcttctagaagaggccaaagtgacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagccaggcaggctgccctgagacgaggagggctctggtcccgtcactctccatgccctgacaacagtgcttgtagctttgatgtggaacaggggccctgggcatttctgctgagaaccaaactgctgctgtgataacctctcctttggcccctaaaaggacctgtttttatctacctgtgtgacttgaagtggccatatgctgtcaggggtgcggagtggcccctgacttcactgctgtcccgggaacatggacccccaggcttggcgtaggtgtttgcttccttctactggcattcactgaagccactggggtggggggtggggggtgggagtctctaaagagagactgtcatgggtcattccccacaagagccacatcctcacacctgacagatgcacggcccaaggggctgcagccctgttgcaattccatgcttcccccgccaaccagctcctgctgccatccccagggaggtggcccaggaaggtgcctggcccagaataaggaactggcatactgcaaagtccccagccctgcctctggtggacagcatcgtcctggaatggccacggagtgatgagttgtgtgcttgtccctggcagtggcaggctgtgtcctatggacatcttggcaggacatggaatttggcctcatgacaggcccaactagggataggaaggaaaatgaagagagccagtatttccccttctccagaagcaggtactcagctttctgggaaaagcgtgcctccagccgtggggacaggccatcctactgactacctcttgcttggcatgaaataaactgctatcctccccttggaatctaccgccactctacatcctactgctttggcctccctctcctctcaccagatggcatgtggtgtggcacctgtggctggacacaggaggcctcaggatcacaaatgttacactagacatatgtcctaatgtgctgcccagaaacctcaactgttccccagctactgaggggcactgtcagcgagatgttgggtctggaggtgatgagatcgggccacacttgagctgagtcaccagaccctattgcttcaacagtgcttggcccccgccagcttgtcccagccactctagctgctggatgtgatcctgggacatgtactccaagcctccgtcacaaaaaaaaaatcaccagctgccatagacacgggggaagcttgcggagcccaggtgaacaagctcagcaatcggacatctctggggaaaggaaggtggcacagaccatgttccctggttcctccctgccccttgccaggcttccttattccttactatgggaagaggtcatatcccttccctgcccctcgctgtctttagcaagcaggtttcactgcttcattagaagaggacaagtcaaaagtgaatcatttttcactacttaaggaataaatccaagagctttccagagactggctgctgcagccctgggaatgtctgtggaattactatgtggaaatggaactttgtgttatgctctagacattacagttatttgagtgttactcgttactgttgaggtcagtgcttcgtggcaaatggctgtactggatatcccagctctgctgcccttgttttgctgcatgttaaataaaaccattttcactgta

SEQ ID NO: 138420 - DNA, 560 bp, Homo sapiens
  Payload ID: 7105
  Gene Symbol: GGA3
  Gene Name: golgi-associated, gamma adaptin ear containing, ARF binding protein 3
  ENST ID: ENST00000579743
  CDS Start-End: 423-560
aattcaggcccttgtcccaagtaggaggacattccccaagcaggcgggtaaagtctcctcctggtcaagtgctaacgccacaacagaaacactgccggggaggccgagccccgacctgggaagcagggtgatacactgggtgccacgggccttccctctgcctggcagctgtcgctactcagatccctgcagccctgttgccagtgaaggagctggagtctctgttatgatgtgttcatccagctgataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaagtggggaagttccgctttttgaatgagttaatcaaagtcgtctctccaaagtacctgggggacagggtgtctgagaaagtgaagaccaaggttattgagctgctg

SEQ ID NO: 138421 - DNA, 4181 bp, Homo sapiens
  Payload ID: 7105
  Gene Symbol: GGA3
  Gene Name: golgi-associated, gamma adaptin ear containing, ARF binding protein 3
  ENST ID: ENST00000621217
  CDS Start-End: 35-496
gagttttgaagccgcggggccgggcggctgcaatatggcggaggcggaaggggaaagcctggagtcctggctcaataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaagtggggaagttccgctttttgaatgagttaatcaaagtcgtctctccaaagtacctgggggacagggtgtctgagaaagtgaagaccaaggttattgagctgctgtacagctggaccatggccctgccagaagaagcaaagatcaaagacgcctaccacatgctgaagagacaggcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccaggcctcaggacctccacggagccgctcctctagccaggccgaggccaccctggggcccagcagcacaagcaacgccctctcctggctggacgaggagctactctgcttgggtgcggcccacagggggcgtcaggggcatcccctgacagggctctgggaggaagggtgtgtggaattaggagccctgagcggggccccagtgtgactgttggggtgggcaaagaaccctgagttggaggtactcagtgaagttcagcgaccctgagggccccagggccatcctcccggtggactctgcctcctgccctgcaccccgccccacaggccccccgcttctgcatcatggactggagcgctccattcccctctggaggctgcctgcagaacagcttctcccggcgccttcacccattgatgtcacttgtcacctgacccctcctcaggcaaggcggggctagggctgcctagctcagagcctcttctcatcctgttttcttctctattgtcaggcctcgccgacccagcccctaatgttcctcccaaagagtcagctgggaacagccagtggcacctgctccagagggaacagtccgacctggacttcttcagccccaggccggggaccgctgcctgtggcgcctccgatgctcctctgctccagccctcagccccctcctcaagcagctcccaagctccactgccgcctcccttcccagctcctgtggtcccagccagtgttcctgcccccagtgcgggctcctccttgttttctactggagtggccccagccttggccccaaaagttgagcccgcagtccctgggcaccatggcttggcgttgggcaacagcgcgctgcaccacctggatgccctcgatcagcttctagaagaggccaaagtgacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagccaggcaggctgccctgagacgaggagggctctggtcccgtcactctccatgccctgacaacagtgcttgtagctttgatgtggaacaggggccctgggcatttctgctgagaaccaaactgctgctgtgataacctctcctttggcccctaaaaggacctgtttttatctacctgtgtgacttgaagtggccatatgctgtcaggggtgcggagtggcccctgacttcactgctgtcccgggaacatggacccccaggcttggcgtaggtgtttgcttccttctactggcattcactgaagccactggggtggggggtggggggtgggagtctctaaagagagactgtcatgggtcattccccacaagagccacatcctcacacctgacagatgcacggcccaaggggctgcagccctgttgcaattccatgcttcccccgccaaccagctcctgctgccatccccagggaggtggcccaggaaggtgcctggcccagaataaggaactggcatactgcaaagtccccagccctgcctctggtggacagcatcgtcctggaatggccacggagtgatgagttgtgtgcttgtccctggcagtggcaggctgtgtcctatggacatcttggcaggacatggaatttggcctcatgacaggcccaactagggataggaaggaaaatgaagagagccagtatttccccttctccagaagcaggtactcagctttctgggaaaagcgtgcctccagccgtggggacaggccatcctactgactacctcttgcttggcatgaaataaactgctatcctccccttggaatctaccgccactctacatcctactgctttggcctccctctcctctcaccagatggcatgtggtgtggcacctgtggctggacacaggaggcctcaggatcacaaatgttacactagacatatgtcctaatgtgctgcccagaaacctcaactgttccccagctactgaggggcactgtcagcgagatgttgggtctggaggtgatgagatcgggccacacttgagctgagtcaccagaccctattgcttcaacagtgcttggcccccgccagcttgtcccagccactctagctgctggatgtgatcctgggacatgtactccaagcctccgtcacaaaaaaaaaatcaccagctgccatagacacgggggaagcttgcggagcccaggtgaacaagctcagcaatcggacatctctggggaaaggaaggtggcacagaccatgttccctggttcctccctgccccttgccaggcttccttattccttactatgggaagaggtcatatcccttccctgcccctcgctgtctttagcaagcaggtttcactgcttcattagaagaggacaagtcaaaagtgaatcatttttcactacttaaggaataaatccaagagctttccagagactggctgctgcagccctgggaatgtctgtggaattactatgtggaaatggaactttgtgttatgctctagacattacagttatttgagtgttactcgttactgttgaggtcagtgcttcgtggcaaatggctgtactggatatcccagctctgctgcccttgttttgctgcatgttaaataaaaccattttcactgta

SEQ ID NO: 138422 - DNA, 1876 bp, Homo sapiens
  Payload ID: 7106
  Gene Symbol: GFY
  Gene Name: golgi-associated, olfactory signaling regulator
  Uniprot ID: I3L273
  ENST ID: ENST00000576655
  CDS Start-End: 320-1876
aggaacagagacacaaagagaaggacaaagacagagtggccgaggaagaaatagagagaaagaatgggaacgacagaaaaagaaaggaaaaggaagaaaacaagaaaagagagcgaaggagatggaaacgaacagtcagatggagatggaggagggaaagaaaaggctctcagaaagacagacggaaatggaaggacgtcctggtctggaaggagctgcccagagataaatacagcagcgagaggcccagaaagatcgaggctctgcttatctgctgttaccttggacaccagagcagctataggtatctgccagagctatgaaatcattcagccggatcctcttcctcgtcttcctcctcgccggcctgaggtccaaggccgctccctcagcccctctgcctttgggctgtggctttccggacatggcccacccctctgagacttcccctctgaagggtgcttctgaaaattccaaacgagatcgccttaacccagaatttcctgggactccttaccctgagccttccaagctacctcatacggtttccctggaaaccttcccacttgacttcactgagcccctcaaccctgacctccgagaaaccccgcacccagagtctcctgagacccccaaagctgactcactcacaacctcaatatcagaatccctggacatgcccaaaactaacctctccaaaatggcacacccagagtcttctgagacccccacacctggcccaactgaaatgccacacccaggatcccctgagacccccaaacctaacttctccaaaacttcacgcccagaatttcctgagaccccaaacactgaccttatgcaaactacaccccaagaatccccagagattctgcagcttaatgccactgaagtctcacaggcagaactccccgagacctcaaacactaaccctaccaagacccctgaccccaaatccccagaaaagcatgacctcaactccactgagaccccaaactctgaatttctccaagctctccatcctgacccttctaaaaccccccacccagaatcccatgtgacccacaatcccagccccaccgaaatttcccaaacagaattccccacaacctactaccaaaatgcaacagatgtacccaggacctccgaccctcaaatctccactagtctctacccagaaacacctgtgcccttcaaggatgacgccactgctctaaatgagctgtccctgaatcccaaaccaggaacacctgcagccatccagcccgactccccaaaattgcccacttcagattctccaggaatggttgagctgaaggccccccagaactctggccctaaggagtccaacgtccctcctccctcagcccggattgcaggtccccctgctcttccagggcgccccagtcagttggcccctgccactctgcgggcaccccagaggcacagccgaggtgagggagtcaacaccatcatcgtggtggagcgagtgaaggagaccggcgtgactctggtggggcgaccacgtggcgcagcaggcggggccctctgcctgttcttcgcggggaccgcgctgctgatcggcatctttgtgctgctgtggtgtctttaccgccgggcagctagacagcggcccttcgcacatcaccggcttccggacgacggagatgaaccggttctgcatttggacgccccgaaagacccctacgacctctacttttatgctccggatacctgggtcccttcccacatcgccaccaagcagcccccgcccacacctcctctgccaccaaagctgcccccgccgccccgcgggggtcgcccgcagcgtctggaggccctgtcccccgccacgctccccaacaacttcgtgtga

SEQ ID NO: 138423 - DNA, 1557 bp, Homo sapiens
  Payload ID: 7106
  Gene Symbol: GFY
  Gene Name: golgi-associated, olfactory signaling regulator
  Uniprot ID: I3L273
  ENST ID: ENST00000610896
  CDS Start-End: 1-1557
atgaaatcattcagccggatcctcttcctcgtcttcctcctcgccggcctgaggtccaaggccgctccctcagcccctctgcctttgggctgtggctttccggacatggcccacccctctgagacttcccctctgaagggtgcttctgaaaattccaaacgagatcgccttaacccagaatttcctgggactccttaccctgagccttccaagctacctcatacggtttccctggaaaccttcccacttgacttcactgagcccctcaaccctgacctccgagaaaccccgcacccagagtctcctgagacccccaaagctgactcactcacaacctcaatatcagaatccctggacatgcccaaaactaacctctccaaaatggcacacccagagtcttctgagacccccacacctggcccaactgaaatgccacacccaggatcccctgagacccccaaacctaacttctccaaaacttcacgcccagaatttcctgagaccccaaacactgaccttatgcaaactacaccccaagaatccccagagattctgcagcttaatgccactgaagtctcacaggcagaactccccgagacctcaaacactaaccctaccaagacccctgaccccaaatccccagaaaagcatgacctcaactccactgagaccccaaactctgaatttctccaagctctccatcctgacccttctaaaaccccccacccagaatcccatgtgacccacaatcccagccccaccgaaatttcccaaacagaattccccacaacctactaccaaaatgcaacagatgtacccaggacctccgaccctcaaatctccactagtctctacccagaaacacctgtgcccttcaaggatgacgccactgctctaaatgagctgtccctgaatcccaaaccaggaacacctgcagccatccagcccgactccccaaaattgcccacttcagattctccaggaatggttgagctgaaggccccccagaactctggccctaaggagtccaacgtccctcctccctcagcccggattgcaggtccccctgctcttccagggcgccccagtcagttggcccctgccactctgcgggcaccccagaggcacagccgaggtgagggagtcaacaccatcatcgtggtggagcgagtgaaggagaccggcgtgactctggtggggcgaccacgtggcgcagcaggcggggccctctgcctgttcttcgcggggaccgcgctgctgatcggcatctttgtgctgctgtggtgtctttaccgccgggcagctagacagcggcccttcgcacatcaccggcttccggacgacggagatgaaccggttctgcatttggacgccccgaaagacccctacgacctctacttttatgctccggatacctgggtcccttcccacatcgccaccaagcagcccccgcccacacctcctctgccaccaaagctgcccccgccgccccgcgggggtcgcccgcagcgtctggaggccctgtcccccgccacgctccccaacaacttcgtgtga

SEQ ID NO: 138424 - DNA, 4811 bp, Homo sapiens
  Payload ID: 7107
  Gene Symbol: GOLGA1
  Gene Name: golgin A1
  Uniprot ID: Q92805
  ENST ID: ENST00000373555
  CDS Start-End: 335-2638
gcgctgggagacgtgcggttccgggtcgctgctcggctcgccggctgggcggtgggggttggtgacgcgggccggggctcacgagaggcccgggaggcggggctttgctggcttcccagagagaggcaggacagaatgctttgacctccaagctgttttaaatctagtagataagccagatcctgtgttgccataagcccttggcccacatttaagtgggaatgcagctagcttggatgtctgaaactttgtaggcgcctctgtctgaatcctgaacacaggcaccaggactactgagagctcgtcatctgtgcaggatagccacacagcaaacatgtttgcaaaactgaagaagaaaattgcagaagagactgctgttgctcagaggccaggaggtgctactaggatcccacggtctgtgagcaaggaatcagttgcctcaatgggagctgactcaggagatgactttgcttccgatggaagcagctccagagaagatctttcatcccagcttctgagaaggaatgaacagatacggaagttagaggccagactttctgactatgctgaacaggtccgaaacttgcagaagataaaagagaagcttgaaattgcattagaaaaacaccaggattcttccatgcggaaatttcaagagcagaatgagacattccaagccaacagagccaaaatggcagaaggactggctttggcattagccagaaaggaccaggaatggtcagaaaagatggatcagcttgaaaaggagaaaaatattctgacagcccagttacaggaaatgaagaaccagagtatgaatcttttccaaaggagagatgaaatggatgaattagaggggttccagcagcaggaactaagtaaaataaagcacatgcttttaaaaaaagaagaaagtctagggaaaatggaacaagaattggaggcacgaaccagagaacttagtcgtacccaggaggagttgatgaactccaatcagatgtcatcagacttaagccagaagctagaagaattgcagagacactactcaacgctggaagagcagagagatcatgtgatagcttcaaaaacaggtgcagaaagtaagatcacagccctggaacaaaaggaacaagagctccaagcactcattcagcagctttccattgatttgcaaaaggtcactgctgaaactcaagagaaagaagacgttatcacacatttgcaagagaaggttgcatccttggagaagagactagaacagaacttatcaggagaagaacacttgcaagaactcctgaaagagaaaacacttgctgagcagaatttggaggataccagacaacagctcttggcagccagaagcagccaggctaaggccattaacaccctggagactcgggtgagagaactggagcagaccttgcaggcctctgaggagcagctccaacagagcaagggcattgtggctgcccaggaaactcagatacaggagctcgctgccgccaaccaggagagcagccatgtgcagcagcaggcccttgctctggagcagcagttcttggagcgcacccaggcgctagaagcccagatagtggccctggagagaacgcgggcagctgaccagaccaccgcagagcaagggatgagacaactggagcaagaaaatgcagcccttaaagaatgcaggaatgaatatgaacgttctttacaaaatcaccaatttgaactaaagaagctgaaggaagaatggagccaaagagaaattgtgagcgtggccatggctcaagccctggaggaggtgcggaagcaaagggaagagttccagcaacaggcagctaacctgacagccataatagacgagaaggaacagaatctgcgggaaaaaaccgaagtgcttctccagaaagagcaggagattctccagctggagcgaggtcacaactctgccctgctgcagatacaccagctgcaggccgagctggaggccctgaggaccctcaaggcggaggaggctgcagtggtcgcggagcaggaggacctgctgaggctgcggggcccattgcaggccgaagcactctcagtcaatgagtcgcacgtgacctcgagggccatgcaggaccctgtgttccagcttccaactgcaggaagaacaccaaatggtgaggttggggccatggatctcacacagctacagaaggagaaacaggacttggagcagcaacttctggagaaaaataagaccataaagcagatgcagcagcggatgctggagctccggaagactctgcagaaggagctgaaaatcagacccgataatgagctcttcgaagtccgggagaaacctggacctgagatggcaaacatggcgccttccgtcacgaataacactgacctgacagatgcccgcgagatcaactttgagtaccttaaacatgtggttttaaaattcatgtcttgtcgcgaatccgaggcttttcatcttataaaagctgtgtcagtgttgctgaacttttcccaagaggaggagaacatgctcaaggaaactctggaatataagatgtcatggtttgggtccaaaccagctcccaagggcagcatccggccgtctatctcaaaccctcggataccatggtcctagaggggactacccaaggatggagctccgtgggttgacactttttctgtgaaaagaacactgacacaccagtctgggtgggtttttaatcactgtaactgcagtattttgtacaagtgtctaaacattgtttacaagactaaggcccacttccctgcaggctgacctgaacctcagggggtagctgatcctgtcattctggtcaccaaacaggagggtcctggcactacccagatttccacagtgctgctaatatcccagctccagccagcaccccatctgcacctgaatcctctaacttcacggtagcacttacagctgaagccatcagcatctggcaggcacacctgagtcaccatgtagcgctgctactggaggtagagacggccctttgagatggtgcccagcaggccaaacccacctgcctctgccaggaacagccaactccatgggaactctatgggagtggcttttaaaaattcagatgagttagaagctttttatcccttcctctcaagaaaatattctttcaccctgtctctcaaaccacctagaactttagaggatccatctttaagggtcggtgtggatgaatgagaaaatgcacctttctgacagtatctccactttacttaagaaaactagcaaatatatgaaaagacccttagtaccaaatacactcaattgcctttttaatgaatgtacttgtcttggataggttgctggtaaaccattttaaactattttttatagctgaagttcttcactactataaacatgtcttctgtactataaaatccatttaactggtgttcttaaaatcagagcgtccagaggaaattcttcctaaaactaggattcctgttcctttgtcttctcactcgcactctggcactgctccctctgaagtgcagtgggatctcgtgtgctttgtcttgattctgtgctgcgctgccgctgggcgatgcagaccacctgtcttctactgaaggacagtccgctgtctccagtgggggcagcagctgtcccccagcctcgatggagacactggggcagtctgccttgtctgtggagctgctctctctccctcatcccaccccaaatacttaaaatgacactacacccagacggcgcccagctggctgcagcacttgtagcatgcacatgactctggtagtaaccaacaaaaacttgttttatggattcctcgtttactgaggaaagggaacatgctggttctggaaaagccacaatattgaatctaaaaggaaaccgtttattgtttgatgaaagtttcactggttaaataaaaaactaaattaataactggagcctctaaatttattatccattatccagtgatggaaagttgtatttctcaatcatgcttagggccaaaataggtatataaaatgtgtcacagaaaaacacgcatttgcaacgttaacctaacgaaatttccatgaagaaccaagtcagggcagcatctccttagtcccagctcaggctctctgccttccagaggccgcttctccagtgactaacctcctcctctggctcctccttgcagacagttatcccttgtttagaacacgaatttccatttacctggtgggaacacgaaacaggagtctcttctgttctgcaagtttgatgggtaagaggtagccttttttcaaagtaggatttcctttttcaactgttccaggaaagaatctctaagactgggtagctcacagccagccaaaggcagctacatttccacagaagcccatccgctgcctccgtggcttctccagccattgaactggtcccacacgcaccccaggccccactcctcggcagtttcaggtgtagctgtggggcccgttcctaggtctgtactcactttagggaggcttcactgactaggctttcctcctgcatgttgaatttccttcagctttaagaggaagagtggaataaatattctaagtgatttaatgcactttgacttgtataaaactttctgtgttagcgacggtatctatagccctttatacgagcgatggatcttgagctctccttccatgttgtaaatagggattgtattcttgaaaactgctgtagcaaattcatctgtggtgcaatacactttttgattaaagctcttcaatccagatgcaactacaatgga

SEQ ID NO: 138425 - DNA, 589 bp, Homo sapiens
  Payload ID: 7107
  Gene Symbol: GOLGA1
  Gene Name: golgin A1
  ENST ID: ENST00000421514
  CDS Start-End: 252-589
tgagaagcagtttggacccagctgaaaaattttatttatggagacttgtaatcagcctgatatacagagaacactctggactggaaatatagtcagatcctgtgttgccataagcccttggcccacatttaagtgggaatgcagctagcttggatgtctgaaactttgtaggcgcctctgtctgaatcctgaacacaggcaccaggactactgagagctcgtcatctgtgcaggatagccacacagcaaacatgtttgcaaaactgaagaagaaaattgcagaagagactgctgttgctcagaggccaggaggtgctactaggatcccacggtctgtgagcaaggaatcagttgcctcaatgggagctgactcaggagatgactttgcttccgatggaagcagctccagagaagatctttcatcccagcttctgagaaggaatgaacagatacggaagttagaggccagactttctgactatgctgaacaggtccgaaacttgcagaagataaaagagaagcttgaaattgcattagaaaaacaccaggattcttccatgcggaaatttcaagagcagaatgagacatt

SEQ ID NO: 138426 - DNA, 935 bp, Homo sapiens
  Payload ID: 7107
  Gene Symbol: GOLGA1
  Gene Name: golgin A1
  ENST ID: ENST00000485337
  CDS Start-End: 1-456
gacttaagccagaagctagaagaattgcagagacactactcaacgctggaagagcagagagatcatgtgatagcttcaaaaacaggtgcagaaagtaagatcacagccctggaacaaaaggaacaagagctccaagcactcattcagcagctttccattgatttgcaaaaggtcactgctgaaactcaagagaaagaagacgttatcacacatttgcaagagaaggttgcatccttggagaagagactagaacagaacttatcaggagaagaacacttgcaagaactcctgaaagagaaaacacttgctgagcagaatttggaggataccagacaacagctcttggcagccagaagcagccaggctaaggccattaacaccctggagactcgggtgagagaactggagcagaccttgctctggagcagcagttcttggagcgcacccaggcgctagaagcccagatagtggccctggagagaacgcgggcagctgaccagaccaccgcagagcaagggatgagacaactggagcaagaaaatgcagcccttaaagaatgcaggaatgaatatgaacgttctttacaaaatcaccaatttgaactaaagaagctgaaggaagaatggagccaaagagaaattgtgagcgtggccatggctcaagccctggaggaggtgcggaagcaaagggaagagttccagcaacaggcagctaacctgacagccataatagacgagaaggaacagaatctgcgggaaaaaaccgaagtgcttctccagaaagagcaggagattctccagctggagcgaggtcacaactctgccctgctgcagatacaccagctgcaggccgagctggaggccctgaggaccctcaaggcggaggaggctgcagtggtcgcggagcaggaggacctgctgaggctgcggggccca

SEQ ID NO: 138427 - DNA, 4107 bp, Homo sapiens
  Payload ID: 7107
  Gene Symbol: GOLGA1
  Gene Name: golgin A1
  ENST ID: ENST00000475407
  CDS Start-End: 1-505
cttgcagaagataaaagagaagcttgaaattgcattagaaaaacaccaggattcttccatgcggaaatttcaagagcagaatgagacattccaagccaacagagccaaaatggcagaaggactggctttggcattagccagaaaggaccaggaatggtcagaaaagatggatcagcttgaaaaggagaaaaatattctgacagcccagttacaggaaatgaagaaccagagtatgaatcttttccaaaggagagatgaaatggatgaattagaggggttccagcagcaggaactaagtaaaataaagcacatgcttttaaaaaaagaagaaagtctagggaaaatggaacaagaattggaggcacgaaccagagaacttagtcgtacccaggaggagttgatgaactccaatcagatgtcatcagacttaagccagaagctagaagaattgcagagacactactcaacgctggaagagcagaggttcttgcttggtcactgctgaaactcaagagaaagaagacgttatcacacatttgcaagagaaggttgcatccttggagaagagactagaacagaacttatcaggagaagaacacttgcaagaactcctgaaagagaaaacacttgctgagcagaatttggaggataccagacaacagctcttggcagccagaagcagccaggctaaggccattaacaccctggagactcgggtgagagaactggagcagaccttgcaggcctctgaggagcagctccaacagagcaagggcattgtggctgcccaggaaactcagatacaggagctcgctgccgccaaccaggagagcagccatgtgcagcagcaggcccttgctctggagcagcagttcttggagcgcacccaggcgctagaagcccagatagtggccctggagagaacgcgggcagctgaccagaccaccgcagagcaagggatgagacaactggagcaagaaaatgcagcccttaaagaatgcaggaatgaatatgaacgttctttacaaaatcaccaatttgaactaaagaagctgaaggaagaatggagccaaagagaaattgtgagcgtggccatggctcaagccctggaggaggtgcggaagcaaagggaagagttccagcaacaggcagctaacctgacagccataatagacgagaaggaacagaatctgcgggaaaaaaccgaagtgcttctccagaaagagcaggagattctccagctggagcgaggtcacaactctgccctgctgcagatacaccagctgcaggccgagctggaggccctgaggaccctcaaggcggaggaggctgcagtggtcgcggagcaggaggacctgctgaggctgcggggcccattgcaggccgaagcactctcagtcaatgagtcgcacgtgacctcgagggccatgcaggaccctgtgttccagcttccaactgcaggaagaacaccaaatggtgaggttggggccatggatctcacacagctacagaaggagaaacaggacttggagcagcaacttctggagaaaaataagaccataaagcagatgcagcagcggatgctggagctccggaagactctgcagaaggagctgaaaatcagacccgataatgagctcttcgaagtccgggagaaacctggacctgagatggcaaacatggcgccttccgtcacgaataacactgacctgacagatgcccgcgagatcaactttgagtaccttaaacatgtggttttaaaattcatgtcttgtcgcgaatccgaggcttttcatcttataaaagctgtgtcagtgttgctgaacttttcccaagaggaggagaacatgctcaaggaaactctggaatataagatgtcatggtttgggtccaaaccagctcccaagggcagcatccggccgtctatctcaaaccctcggataccatggtcctagaggggactacccaaggatggagctccgtgggttgacactttttctgtgaaaagaacactgacacaccagtctgggtgggtttttaatcactgtaactgcagtattttgtacaagtgtctaaacattgtttacaagactaaggcccacttccctgcaggctgacctgaacctcagggggtagctgatcctgtcattctggtcaccaaacaggagggtcctggcactacccagatttccacagtgctgctaatatcccagctccagccagcaccccatctgcacctgaatcctctaacttcacggtagcacttacagctgaagccatcagcatctggcaggcacacctgagtcaccatgtagcgctgctactggaggtagagacggccctttgagatggtgcccagcaggccaaacccacctgcctctgccaggaacagccaactccatgggaactctatgggagtggcttttaaaaattcagatgagttagaagctttttatcccttcctctcaagaaaatattctttcaccctgtctctcaaaccacctagaactttagaggatccatctttaagggtcggtgtggatgaatgagaaaatgcacctttctgacagtatctccactttacttaagaaaactagcaaatatatgaaaagacccttagtaccaaatacactcaattgcctttttaatgaatgtacttgtcttggataggttgctggtaaaccattttaaactattttttatagctgaagttcttcactactataaacatgtcttctgtactataaaatccatttaactggtgttcttaaaatcagagcgtccagaggaaattcttcctaaaactaggattcctgttcctttgtcttctcactcgcactctggcactgctccctctgaagtgcagtgggatctcgtgtgctttgtcttgattctgtgctgcgctgccgctgggcgatgcagaccacctgtcttctactgaaggacagtccgctgtctccagtgggggcagcagctgtcccccagcctcgatggagacactggggcagtctgccttgtctgtggagctgctctctctccctcatcccaccccaaatacttaaaatgacactacacccagacggcgcccagctggctgcagcacttgtagcatgcacatgactctggtagtaaccaacaaaaacttgttttatggattcctcgtttactgaggaaagggaacatgctggttctggaaaagccacaatattgaatctaaaaggaaaccgtttattgtttgatgaaagtttcactggttaaataaaaaactaaattaataactggagcctctaaatttattatccattatccagtgatggaaagttgtatttctcaatcatgcttagggccaaaataggtatataaaatgtgtcacagaaaaacacgcatttgcaacgttaacctaacgaaatttccatgaagaaccaagtcagggcagcatctccttagtcccagctcaggctctctgccttccagaggccgcttctccagtgactaacctcctcctctggctcctccttgcagacagttatcccttgtttagaacacgaatttccatttacctggtgggaacacgaaacaggagtctcttctgttctgcaagtttgatgggtaagaggtagccttttttcaaagtaggatttcctttttcaactgttccaggaaagaatctctaagactgggtagctcacagccagccaaaggcagctacatttccacagaagcccatccgctgcctccgtggcttctccagccattgaactggtcccacacgcaccccaggccccactcctcggcagtttcaggtgtagctgtggggcccgttcctaggtctgtactcactttagggaggcttcactgactaggctttcctcctgcatgttgaatttccttcagctttaagaggaagagtggaataaatattctaagtgatttaatgcactttgacttgtataaaactttctgtgttagcgacggtatctatagccctttatacgagcgatggatcttgagctctccttccatgttgtaaatagggattgtattcttgaaaactgctgtagcaaattcatctgtggtgcaatacactttttgattaaagctcttcaa

SEQ ID NO: 138428 - DNA, 1439 bp, Homo sapiens
  Payload ID: 7108
  Gene Symbol: GOLGA2
  Gene Name: golgin A2
  ENST ID: ENST00000450617
  CDS Start-End: 20-1439
ggttgccgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatattcaggacattctgaaggtgctggtgtccgaccttaaccgttccaatggggtagcgctccccccattggacaagtggaagacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagagccggtaccaacagctagcggtagccctggactccagctatgtaacaaacaaacaactcaatatcacgatagagaaattgaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatgg

SEQ ID NO: 138429 - DNA, 704 bp, Homo sapiens
  Payload ID: 7108
  Gene Symbol: GOLGA2
  Gene Name: golgin A2
  ENST ID: ENST00000458730
  CDS Start-End: 1-704
attcaggacattctgaaggtgctggtgtccgaccttaaccgttccaatggggtagcgctccccccattggacaagtggaagacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacac

SEQ ID NO: 138430 - DNA, 4260 bp, Homo sapiens
  Payload ID: 7108
  Gene Symbol: GOLGA2
  Gene Name: golgin A2
  Uniprot ID: Q08379
  ENST ID: ENST00000421699
  CDS Start-End: 14-3022
cgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagagccggtaccaacagctagcggtagccctggactccagctatgtaacaaacaaacaactcaatatcacgatagagaaattgaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatggctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccata

SEQ ID NO: 138431 - DNA, 428 bp, Homo sapiens
  Payload ID: 7108
  Gene Symbol: GOLGA2
  Gene Name: golgin A2
  ENST ID: ENST00000490628
  CDS Start-End: 12-311
ggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatgtgagtcttggatggccaggctcctggggacagggggcccaaggggcagtagagggtaattgttatgattgtggaagaactgttgggtactgattaagagttctgggtttgtatcctacctgtccatctgctagggatgtgatttagggcaaattgcttgagctttttgggcctctcttttcacaactataaagtattgttttacttaca

SEQ ID NO: 138432 - DNA, 2973 bp, Homo sapiens
  Payload ID: 7108
  Gene Symbol: GOLGA2
  Gene Name: golgin A2
  ENST ID: ENST00000609374
  CDS Start-End: 1-2973
atgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagagccggtaccaacagctagcggtagccctggactccagctatgtaacaaacaaacaactcaatatcacgatagagaaattgaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatggctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaa

SEQ ID NO: 138433 - DNA, 4259 bp, Homo sapiens
  Payload ID: 7108
  Gene Symbol: GOLGA2
  Gene Name: golgin A2
  Uniprot ID: Q08379
  ENST ID: ENST00000611957
  CDS Start-End: 14-3022
cgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagagccggtaccaacagctagcggtagccctggactccagctatgtaacaaacaaacaactcaatatcacgatagagaaattgaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatggctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccat

SEQ ID NO: 138434 - DNA, 2212 bp, Homo sapiens
  Payload ID: 7108
  Gene Symbol: GOLGA2
  Gene Name: golgin A2
  ENST ID: ENST00000610329
  CDS Start-End: 117-977
gtcggaagaaacccgacagagcaaattggccgcagcgaagaaaaagttgagagaatatcagcagaggaatagccctggtgttcctacaggagcgaaaaagaagaagaaaataaaaaatggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagcc

SEQ ID NO: 138435 - DNA, 9252 bp, Homo sapiens
  Payload ID: 7109
  Gene Symbol: GOLGA3
  Gene Name: golgin A3
  Uniprot ID: Q08378
  ENST ID: ENST00000204726
  CDS Start-End: 560-5056
ggcctgggcgcgtccctgcagcgtggcgggacggccccgttccagtcacccccgcctcgctgcggtggcctcgggcctgggcgcccgccttcagctgcggcggagctggctctgtaaatgccggtgcccgcgagccctcctgaatgcttgtctgcgcccgacgagcgcggcctgtcccgaagctgtccactgccaccactcgggcagtgcttgctttagcctggccctttgcagctgaaaggcgtgacatggtgtcgggtggttcgtgggaagtcggggtttcaggagtccgtgtacttccttgtttgtctttgtcgctggccgacttgtcttcattccaggtggccagagcgagtggggccgggcgttgtcacgggtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgctctacagattctcccctgcccctggagaaggaggagcaggtccgacttcaggctcggaagtggctggaagagcagctcaaacagtacagggtgaagcgccagcaggagaggtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcagcgtgtccttggagagctctgcagcagaaacacaggaggagatgctgcaggtgctcaaagagaaaatgcgactcgaaggacagctggaagccttgtcactggaggcgagtcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacagtgcacgacctgcgacagcagatgacagccttgcagagccagcttcagcaggtgcagctggagcggacgacgctgaccagcaagctgaaggcgtcgcaggcggagatctcgtccctgcagagtgtccggcagtggtaccagcagcagctcgccctggcacaggaggcccgcgtcaggctgcagggtgagatggcccacatccaggttggacagatgacccaggcaggtctcctggagcacctgaaactcgagaatgtgtccctgtcccagcagctgacggaaactcagcacaggtccatgaaggagaaggggcgcatcgcggcacagctgcagggcattgaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaaagaagaggaggatcgccagatgaagcatcttgtccaggccctgcaggcctcactagagaaggagaaggagaaggtgaacagcctcaaggagcaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacgagaaaggagccgaaaggcgaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtggtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccgcgcctggccaggccggctgcagtttctcacttccctgttccattcagtaagagctttacttttccgcagaaatgaaattttatctgtacctttggctttttacttgtttttttggatagccatcccaccataggatgtgtacatagatactgaatatcataatccaatctttgttttttttttttttttttttttgagacagagtctcgctttgttgcccaggctggagtgcagtggcacactctccgctcactgcaagctccgcctcccaggttcatgcgattctcctgcctcagcctctcgagtagctgggattacaggcgtgcgccactatgccaggctaatgtttgtatttttagtagcaatggggtttcaccatgttggccaggatggtctcgatctcctgacctcaagtgatctgcccatctcagcctcccaaagtgctgggattacaggcgtgagcccctgcgcccggcctgtcacccagtctttaagaagcatatgctcatgttattgaagaagaacctacttattattgattgccttttgaaaatttgttgggaataatttacctgcaggatttagggatagtcagaaaattctaagaaatataattattttatttaccttctaaagccaaatattcttacacagaaaggtcctctgttgttctggttttactttgttgctgaggatctttccttcctgctggtctcttcctctcaggccactggccctgtgtgattccaccgtggctggccactgggaaggggcagcttggacccttggtcaggcctgacggccatcaggaggcacaaggacactgaggccccatatctgatctgacctttgggggggcacagggagaggccggtggaggaggaggaggagagcagaccaggggctccctgcagcgactcccgcggtttcccctggagtcagccaggtgtaggtcgcaggcggtaacaaacctcacactcctgttccccaagtgaaaatctttaccattgtctgtgggagcgcctgtactcgtgtgtaggagcacctgtacttctgcagtcatcgagaagtcctggatcttttgtggttacaccagcatcatgtggcaagcagaggcgacttccggaagagacaggcaggcaccgtgaggaaggtggctgtgctctcccaggtgtctcagagacagatgccttatttaaaatcagcacgacatgtgtgagatcttctgtttcctaccccaaatcctgaaaccctgcagacactggctgactgggagaggtggggtctgtaagttgtcccctagtttgctaagaaaatctaaaataatatttattatatgagttaggagagagagaatgggtccgcgtggcctcctctgcagatgtactggtctgaaatgaggttctgagtcactggccaggccagatgtgctcatgtcggtgtctggtgtctgttttgtggagaaaacagtatggtgtgttttaagctatttgtgttctgttgtaatatacttttagaaggttaattggtaaggttaaggtagcattaaccacaaagatgtttggtatttaaaaaatattctctagcaaatattggaatttccaaaatatatcatttgtacagggttaattttgaaataatacttgaaaatttcattataaatatatcctactttttatcttaagttgaagatgttatttactaaattgttcttgtaccattagaaaaaaaaatacggcaatttacgttcttatttattttggctgtactacccctttgttttaattttaaaatcaagaaatcgggccgggcgcggtggctcatgcctgtaatcccagcactttgggaggccgaggcgggtggatcacctgaggtcaagaggtccagaccatcctggccaacatggcaaaaccccgtctttactaaacatacaaaaattagccgggtgtcgtagtgcgcacctataatcccagctacttgggaggctgaggcaggagaatcacttgaacccaggaggcggagcttgcagtgagccgagatcgcgccactgccctccagcctgggcaacagagcgagactccgtctcaaaaataaataaatgattttaaaaaatctaaaatcgagaaatcacacattcagtggggagcgacttctccttgcttatgggaagtcctcaagtgagtgatgttcaccatgtatttttttttctcttaggacagactaattctgaaaataccgaaggaaaagtagctctatgttctcaccccggttttcctgcgtgtgtgcccttgggtgcgatgcctcccccagcgctctgtggtcgccggtgccagggccccctctggtttggcagggcctggctgcctttgctccctgcagtgagtcttttggtgttttcatgcacggcttgtgcttctggatctgaggcctctcgtgttcacgcggacacttccttccttaagaagacgcctaaaagaggaagttggaattttttttttttttttttgagacagagtctcgctctgtcgcccaggctggagtgcagtggcgtgatctctgctcactgcaagctccgccatctgggttcaagcgattctcctgcctcattctccccagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgatgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagattttc

SEQ ID NO: 138436 - DNA, 5496 bp, Homo sapiens
  Payload ID: 7109
  Gene Symbol: GOLGA3
  Gene Name: golgin A3
  Uniprot ID: Q08378
  ENST ID: ENST00000456883
  CDS Start-End: 711-4883
tccgccggagcatccgggccgggcggcctccggggctgccagagcagcagggtgaggggctcggaggccgcggcgcctcggggctcgggctcccgctcccgctcccgctcccgcagtgcatgggcgggggaggctcgaggggcggcggcggggcctgggcgcgtccctgcagcgtggcgggacggccccgttccagtcacccccgcctcgctgcggtggcctcgggcctgggcgcccgccttcagctgcggcggagctggctctgtaaatgccggtgcccgcgagccctcctgaatgcttgtctgcgcccgacgagcgcggcctgtcccgaagctgtccactgccaccactcgggcagtgcttgctttagcctggccctttgcagctgaaaggcgtgacatggtgtcgggtggttcgtgggaagtcggggtttcaggagtccgtgtacttccttgtttgtctttgtcgctggccgacttgtcttcattccaggtggccagagcgagtggggccgggcgttgtcacgggtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgctctacagattctcccctgcccctggagaaggaggagcaggtccgacttcaggctcggaagtggctggaagagcagctcaaacagtacagggtgaagcgccagcaggagaggtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcagcgtgtccttggagagctctgcagcagaaacacaggaggagatgctgcaggtgctcaaagagaaaatgcgactcgaaggacagctggaagccttgtcactggaggcgagtcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacagtgcacgacctgcgacagcagatgacagccttgcagagccagcttcagcaggtgcagctggagcggacgacgctgaccagcaagctgaaggcgtcgcaggcggagatctcgtccctgcagagtgtccggcagtggtaccagcagcagctcgccctggcacaggaggcccgcgtcaggctgcagggtgagatggcccacatccaggttggacagatgacccaggcaggtctcctggagcacctgaaactcgagaatgtgtccctgtcccagcagctgacggaaactcagcacaggtccatgaaggagaaggggcgcatcgcggcacagctgcagggcattgaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaaagaagaggaggatcgccagatgaagcatcttgtccaggccctgcaggcctcactagagaaggagaaggagaaggtgaacagcctcaaggagcaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacggtactcaggcccgcgtccctcccggggtagccgacgtgcgctgtagatgctctcggacaggaggctggcagacgtgttagtcattcagacataaacggatttgttgagcccacactgagcagctgctgtgtagtcagtggtaatggggtgacagatgaaatcatttcattctggtttcattcatccaacagtgttttcctcgttctgtgaattcaaataccactttgttgtaatgtgctttgtaaagcagatgagcggtggtctgtgactcggcagtccctgctgtgtgtgaagggctggggcccgggagctgtgcccaggcgcccggcggttttctgtgctcggtccacatccatgttttccaggaggcaggtgggagggcagcgctcggattgagaggccgtttagcgtcgtgtgcttatctgtggaaaaagtttgaagtcccagaaaagggagcctaagctggaaaacttacttaatttcttacggaaattccacatcaaggtcttgagtatctgatgggagaagcgtctgggagagctgtagtctgtggctcggccccgtcctgccgcagacccaggacttaggttgtctctgctttgctctggttttgtgccttaggaataaaggtgtttcctcagcc

SEQ ID NO: 138437 - DNA, 8870 bp, Homo sapiens
  Payload ID: 7109
  Gene Symbol: GOLGA3
  Gene Name: golgin A3
  Uniprot ID: Q08378
  ENST ID: ENST00000450791
  CDS Start-End: 184-4680
gtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgctctacagattctcccctgcccctggagaaggaggagcaggtccgacttcaggctcggaagtggctggaagagcagctcaaacagtacagggtgaagcgccagcaggagaggtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcagcgtgtccttggagagctctgcagcagaaacacaggaggagatgctgcaggtgctcaaagagaaaatgcgactcgaaggacagctggaagccttgtcactggaggcgagtcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacagtgcacgacctgcgacagcagatgacagccttgcagagccagcttcagcaggtgcagctggagcggacgacgctgaccagcaagctgaaggcgtcgcaggcggagatctcgtccctgcagagtgtccggcagtggtaccagcagcagctcgccctggcacaggaggcccgcgtcaggctgcagggtgagatggcccacatccaggttggacagatgacccaggcaggtctcctggagcacctgaaactcgagaatgtgtccctgtcccagcagctgacggaaactcagcacaggtccatgaaggagaaggggcgcatcgcggcacagctgcagggcattgaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaaagaagaggaggatcgccagatgaagcatcttgtccaggccctgcaggcctcactagagaaggagaaggagaaggtgaacagcctcaaggagcaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacgagaaaggagccgaaaggcgaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtggtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccgcgcctggccaggccggctgcagtttctcacttccctgttccattcagtaagagctttacttttccgcagaaatgaaattttatctgtacctttggctttttacttgtttttttggatagccatcccaccataggatgtgtacatagatactgaatatcataatccaatctttgttttttttttttttttttttttgagacagagtctcgctttgttgcccaggctggagtgcagtggcacactctccgctcactgcaagctccgcctcccaggttcatgcgattctcctgcctcagcctctcgagtagctgggattacaggcgtgcgccactatgccaggctaatgtttgtatttttagtagcaatggggtttcaccatgttggccaggatggtctcgatctcctgacctcaagtgatctgcccatctcagcctcccaaagtgctgggattacaggcgtgagcccctgcgcccggcctgtcacccagtctttaagaagcatatgctcatgttattgaagaagaacctacttattattgattgccttttgaaaatttgttgggaataatttacctgcaggatttagggatagtcagaaaattctaagaaatataattattttatttaccttctaaagccaaatattcttacacagaaaggtcctctgttgttctggttttactttgttgctgaggatctttccttcctgctggtctcttcctctcaggccactggccctgtgtgattccaccgtggctggccactgggaaggggcagcttggacccttggtcaggcctgacggccatcaggaggcacaaggacactgaggccccatatctgatctgacctttgggggggcacagggagaggccggtggaggaggaggaggagagcagaccaggggctccctgcagcgactcccgcggtttcccctggagtcagccaggtgtaggtcgcaggcggtaacaaacctcacactcctgttccccaagtgaaaatctttaccattgtctgtgggagcgcctgtactcgtgtgtaggagcacctgtacttctgcagtcatcgagaagtcctggatcttttgtggttacaccagcatcatgtggcaagcagaggcgacttccggaagagacaggcaggcaccgtgaggaaggtggctgtgctctcccaggtgtctcagagacagatgccttatttaaaatcagcacgacatgtgtgagatcttctgtttcctaccccaaatcctgaaaccctgcagacactggctgactgggagaggtggggtctgtaagttgtcccctagtttgctaagaaaatctaaaataatatttattatatgagttaggagagagagaatgggtccgcgtggcctcctctgcagatgtactggtctgaaatgaggttctgagtcactggccaggccagatgtgctcatgtcggtgtctggtgtctgttttgtggagaaaacagtatggtgtgttttaagctatttgtgttctgttgtaatatacttttagaaggttaattggtaaggttaaggtagcattaaccacaaagatgtttggtatttaaaaaatattctctagcaaatattggaatttccaaaatatatcatttgtacagggttaattttgaaataatacttgaaaatttcattataaatatatcctactttttatcttaagttgaagatgttatttactaaattgttcttgtaccattagaaaaaaaaatacggcaatttacgttcttatttattttggctgtactacccctttgttttaattttaaaatcaagaaatcgggccgggcgcggtggctcatgcctgtaatcccagcactttgggaggccgaggcgggtggatcacctgaggtcaagaggtccagaccatcctggccaacatggcaaaaccccgtctttactaaacatacaaaaattagccgggtgtcgtagtgcgcacctataatcccagctacttgggaggctgaggcaggagaatcacttgaacccaggaggcggagcttgcagtgagccgagatcgcgccactgccctccagcctgggcaacagagcgagactccgtctcaaaaataaataaatgattttaaaaaatctaaaatcgagaaatcacacattcagtggggagcgacttctccttgcttatgggaagtcctcaagtgagtgatgttcaccatgtatttttttttctcttaggacagactaattctgaaaataccgaaggaaaagtagctctatgttctcaccccggttttcctgcgtgtgtgcccttgggtgcgatgcctcccccagcgctctgtggtcgccggtgccagggccccctctggtttggcagggcctggctgcctttgctccctgcagtgagtcttttggtgttttcatgcacggcttgtgcttctggatctgaggcctctcgtgttcacgcggacacttccttccttaagaagacgcctaaaagaggaagttggaattttttttttttttttttgagacagagtctcgctctgtcgcccaggctggagtgcagtggcgtgatctctgctcactgcaagctccgccatctgggttcaagcgattctcctgcctcattctccccagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgatgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaag

SEQ ID NO: 138438 - DNA, 3784 bp, Homo sapiens
  Payload ID: 7109
  Gene Symbol: GOLGA3
  Gene Name: golgin A3
  Uniprot ID: Q08378
  ENST ID: ENST00000545875
  CDS Start-End: 222-3626
ccgggccgggcggcctccggggctgccagagcagcagggtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgctctacagattctcccctgcccctggagaaggaggagcaggtccgacttcaggctcggaagtggctggaagagcagctcaaacagtacagggtgaagcgccagcaggagaggtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcagcgtgtccttggagagctctgcagcagaaacacaggaggagatgctgcaggtgctcaaagagaaaatgcgactcgaaggacagctggaagccttgtcactggaggcgagtcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacagtgcacgacctgcgacagcagatgacagccttgcagagccagcttcagcaggtgcagctggagcggacgacgctgaccagcaagctgaaggcgtcgcaggcggagatctcgtccctgcagagtgtccggcagtggtaccagcagcagctcgccctggcacaggaggcccgcgtcaggctgcagggtgagatggcccacatccaggttggacagatgacccaggcaggtctcctggagcacctgaaactcgagaatgtgtccctgtcccagcagctgacggaaactcagcacaggtccatgaaggagaaggggcgcatcgcggcacagctgcagggcattgaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgaggtgaggcctggccatctgctgtggcggcagcgtggggcaggtcacgtgagccctggacatgccgccacgcgtgagacccgaagaacaaaacttcaccgtgtgcccagcgttgctacttttggtgttgccaccttctgaccgtcggcctctggctctgtggtggggcaggccctgattccagccctctggggaggatcactgtacagcctctttggtggaatggttacagaattcatagtggaacccttctcagttcaaatgctttggttgcaaataagaaacccaacttcgccagg

SEQ ID NO: 138439 - DNA, 498 bp, Homo sapiens
  Payload ID: 7109
  Gene Symbol: GOLGA3
  Gene Name: golgin A3
  ENST ID: ENST00000541013
  CDS Start-End: 1-254
tggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacggtactcaggcccgcgtccctcccggggtagccgacgtgcgctgtagatgctctcggacaggaggctggcagacgtagaaaggagccgaaaggcgaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagcaggagatggacagcctgcagcgccagatggagg

SEQ ID NO: 138440 - DNA, 7673 bp, Homo sapiens
  Payload ID: 7110
  Gene Symbol: GOLGA4
  Gene Name: golgin A4
  Uniprot ID: Q13439
  ENST ID: ENST00000356847
  CDS Start-End: 300-7031
gcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagaatgcatctactcatgcctcgaaatctcctgacagtgttaatggaagtgaaccaagcattcctcagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagcttgttacagcttatcagatgcttcagagagagaagaaaaagctacaaggtatattaagtcagagtcaggataaatcacttcggagaatagcagaattaagagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaaaaatcctcagaagaacaaattgctaagctacagaagcttcatgaaaaggagctggccagaaaagagcaggaactgaccaagaagcttcagacccgagaaagggaatttcaggaacaaatgaaagtagctcttgaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactat

SEQ ID NO: 138441 - DNA, 7772 bp, Homo sapiens
  Payload ID: 7110
  Gene Symbol: GOLGA4
  Gene Name: golgin A4
  Uniprot ID: Q13439
  ENST ID: ENST00000361924
  CDS Start-End: 375-7067
atgtgcgggacccgacattgtgcttgtcccatccggtgctccgtagttagcctctgtgagctccacgtaggccgcgcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagcttgttacagcttatcagatgcttcagagagagaagaaaaagctacaaggtatattaagtcagagtcaggataaatcacttcggagaatagcagaattaagagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaaaaatcctcagaagaacaaattgctaagctacagaagcttcatgaaaaggagctggccagaaaagagcaggaactgaccaagaagcttcagacccgagaaagggaatttcaggaacaaatgaaagtagctcttgaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtttacttcacctcgcagtggtatcttctgagtaaaccatcagtctgtgcttagttaacatgtgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataaca

SEQ ID NO: 138442 - DNA, 1617 bp, Homo sapiens
  Payload ID: 7110
  Gene Symbol: GOLGA4
  Gene Name: golgin A4
  ENST ID: ENST00000450863
  CDS Start-End: 282-1617
cagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagaatgcatctactcatgcctcgaaatctcctgacagtgttaatggaagtgaaccaagcattcctcagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagggtatattaagtcagagtcaggataaatcacttcggagaatagcagaattaagagagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaa

SEQ ID NO: 138443 - DNA, 568 bp, Homo sapiens
  Payload ID: 7110
  Gene Symbol: GOLGA4
  Gene Name: golgin A4
  ENST ID: ENST00000431105
  CDS Start-End: 214-568
agtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagctactagccgggatgatagcagagcctgcttttctctctgagtatactatctttgctttggattcctccaaacatcctaaaacacagagtgacagtgtgaatgcatctactcatgcctcgaaatctcctgacagtgttaatggaagtgaaccaagcattcctcagtcaggtgacacacagtcttttgcacaga

SEQ ID NO: 138444 - DNA, 2036 bp, Homo sapiens
  Payload ID: 7110
  Gene Symbol: GOLGA4
  Gene Name: golgin A4
  ENST ID: ENST00000429018
  CDS Start-End: 281-2036
agttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagaatgcatctactcatgcctcgaaatctcctgacagtgttaatggaagtgaaccaagcattcctcaggaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaacc

SEQ ID NO: 138445 - DNA, 6947 bp, Homo sapiens
  Payload ID: 7110
  Gene Symbol: GOLGA4
  Gene Name: golgin A4
  ENST ID: ENST00000437131
  CDS Start-End: 1-6300
aattcagacagtctcaacaaagaacagttgattcagcggttgcgaagaatggaacgaagcttaagtagctacaggggaaaatattctgagcttgttacagcttatcagatgcttcagagagagaagaaaaagctacaaggtatattaagtcagagtcaggataaatcacttcggagaatagcagaattaagagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaaaaatcctcagaagaacaaattgctaagctacagaagcttcatgaaaaggagctggccagaaaagagcaggaactgaccaagaagcttcagacccgagaaagggaatttcaggaacaaatgaaagtagctcttgaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataac

SEQ ID NO: 138446 - DNA, 1451 bp, Homo sapiens
  Payload ID: 7110
  Gene Symbol: GOLGA4
  Gene Name: golgin A4
  ENST ID: ENST00000444882
  CDS Start-End: 305-805
gccgcgcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataa

SEQ ID NO: 138447 - DNA, 1545 bp, Homo sapiens
  Payload ID: 7110
  Gene Symbol: GOLGA4
  Gene Name: golgin A4
  ENST ID: ENST00000617480
  CDS Start-End: 889-1545
cagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagaatgcatctactcatgcctcgaaatctcctgacagtgttaatggaagtgaaccaagcattcctcagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagggtatattaagtcagagtcaggataaatcacttcggagaatagcagaattaagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgatgctttagggtaa

SEQ ID NO: 138448 - DNA, 2969 bp, Homo sapiens
  Payload ID: 7111
  Gene Symbol: GOLGA5
  Gene Name: golgin A5
  Uniprot ID: Q8TBA6
  ENST ID: ENST00000163416
  CDS Start-End: 257-2452
agtcgcctgcaggtggctgttcgcgtctccctgccgtgcaggcagctcgaaagccactctgttgtggggtcctcgcttcccttccacgtctcccggaagcggtagcagggccccggcgggtcggggaggaggtttactcagcttgggccccctccgggccagccgccgagggggcgcggcccaggacggcggctaggccgtagtgcagcctctccggagtcctcaggtttgccaataggattatcctgctgccatcatgtcttggtttgttgatcttgctggaaaggcagaagatcttttaaaccgagttgatcaaggggctgcaacagctctcagtaggaaagacaatgccagcaacatatatagcaaaaatactgactatactgaacttcaccagcaaaatacagatttgatatatcagactggacctaaatctacgtatatttcatcagcagctgataacattcgaaatcaaaaagccaccatcttagctggcactgcaaatgtgaaagtaggatctcggacaccagtagaggcctctcatcctgttgaaaatgcatctgttcctaggccttcatcccattttgtgcgaagaaaaaagtcagaacctgatgatgagctgctgtttgattttcttaatagttcacagaaggagcctaccgggagggtggaaatcagaaaggaaaaaggcaagacacctgtctttcagagctctcagacatcaagtgtcagttctgtgaaccccagtgtaaccaccatcaaaaccattgaagaaaattcttttgggagccaaacccacgaagctgccagtaactcagattctagccatgaaggtcaagaggaatcttcaaaggaaaatgtgtcatcaaatgctgcctgccctgaccacaccccaacacctaatgatgatggcaaatcacatgaactgtctaaccttcgactggagaatcagctgctgaggaatgaagttcagtctttaaatcaagaaatggcctcgttactccaaagatccaaagagactcaagaagaattaaacaaagcaagagcaagagttgaaaagtggaatgctgaccattcaaagagtgatcgaatgactcgaggactccgagcccaagtagatgacctgactgaagctgtggctgcaaaggattcccagctggctgtactgaaagtgagactccaggaagctgaccagctactgagtactcgcacagaagcattagaagccttacagagtgaaaaatcacgaataatgcaggatcaaagtgaaggtaacagcctgcagaatcaagctctgcagacttttcaggagagactgcatgaagcggatgccactctgaagagagagcaggagagctataaacagatgcagagcgagtttgctgcacgccttaataaagtggaaatggaacgtcagaatttagcagaagcaattacactggccgaaagaaaatactcagatgagaagaagagggttgatgaactgcagcagcaagtcaagctgtataagttgaacttggagtcctctaagcaggaattaattgactacaagcaaaaagctactagaatactgcaatctaaggaaaaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattacaggatatggaggcacagcaagttaatgaagcagaatcagcaagagaacagttacaggatctgcatgaccaaatagctgggcagaaagcatccaaacaagaactagagacagaactggagcgactgaagcaggagttccactatatagaagaagatctttatcgaacaaagaacacattgcaaagcagaattaaagatcgagacgaagaaattcaaaaactcaggaatcagcttaccaataaaactttaagcaatagcagtcagtctgagttagaaaatcgactccatcagctaacagagactctcatccagaaacagaccatgctggagagtctcagcacagaaaagaactccctggtctttcaactggagcgcctcgaacagcagatgaactccgcctctggaagtagtagtaatgggtcttcgattaatatgtctggaattgacaatggtgaaggcactcgtctgcgaaatgttcctgttctttttaatgacacagaaactaatctggcaggaatgtacggaaaagttcgcaaagctgctagttcaattgatcagtttagtattcgcctgggaatttttctccgaagataccccatagcgcgagtttttgtaattatatatatggctttgcttcacctctgggtcatgattgttctgttgacttacacaccagaaatgcaccacgaccaaccatatggcaaatgaaccaagcccagttgttgcagtgattggttgtctttttctagacttgggatctgcaagaaggccaattgcctaaaatttctgagaacagtgcacaagattattttatcactacaagcttttaactttttaagttattgtacaagtattctacctaaatcttccaatttcctttaaatggtaagagtttctaaaacagacaataatttaacaagctcagctctgctttatctgagtttagtggtcctaatatatatgtagagaaagatggtggggttgttcacctctgtacagaccatctgtatgttaggtgacattgattatgggttataatcagggaaactaattgtatttagtgacaaaaataaaaagtttttttttataattcagtctgcttttggattttcatatatttaactttgcaaaaagatttactttgtacatgttacaggcttgattggtgtaaatctttttataaatacataaataaaagaaaaatatgcatttttcttttctaaaa

SEQ ID NO: 138449 - DNA, 759 bp, Homo sapiens
  Payload ID: 7111
  Gene Symbol: GOLGA5
  Gene Name: golgin A5
  ENST ID: ENST00000554700
  CDS Start-End: 1-353
ccaataaaactttaagcaatagcagtcagtctgagttagaaaatcgactccatcagctaacagagactctcatccagaaacagaccatgctggagagtctcagcacagaaaagaactccctggtctttcaactggagcgcctcgaacagcagatgaactccgcctctggaagtagtagtaatgggtcttcgattaatatgtctggaattgacaatggtgaaggcactcgtctgcgaaatgttcctgttctttttaatgacacagaaactaatctggcaggaatgtacggaaaagttcgcaaagctgctagttcaattgatcagtttaggctttgcttcacctctgggtcatgattgttctgttgacttacacaccagaaatgcaccacgaccaaccatatggcaaatgaaccaagcccagttgttgcagtgattggttgtctttttctagacttgggatctgcaagaaggccaattgcctaaaatttctgagaacagtgcacaagattattttatcactacaagcttttaactttttaagttattgtacaagtattctacctaaatcttccaatttcctttaaatggtaagagtttctaaaacagacaataatttaacaagctcagctctgctttatctgagtttagtggtcctaatatatatgtagagaaagatggtggggttgttcacctctgtacagaccatctgtatgttaggtgacattgattatgggttataatcagggaaactaattgtatt

SEQ ID NO: 138450 - DNA, 3176 bp, Homo sapiens
  Payload ID: 7112
  Gene Symbol: GOLGA6A
  Gene Name: golgin A6 family, member A
  Uniprot ID: Q9NYA3
  ENST ID: ENST00000290438
  CDS Start-End: 42-2123
agtcacacagcagccttgtaggtgactggaggtgttcgctgatgtggccccaaccctacctccctccccaccccatgatgttagaagaatctcgacagaataaattggcagcagccaagaaaaagctaaaagaatatcagcaaaggaagagccctggtattccagcaggagcaaagacaaaaaagaaaaaaactgacagtagccctgagacaaccacttccggtggttgccactcacctggggatagccagtaccaagaactagcagtagccctggagtcaagctcagtgacaatcagtcaactcaatgaaaacatagaatcattgaaacagcagaagaaacaagtggaacatcagctggaagaagcaaagaaaacaaacaatgaaatacacaaagcacaaatggagcggttagagacaatcaacatcctcacattggaaaaggcagacttgaagaccaccctttaccatactaaacgtgctgcccgacacttcgaagaagagtccaaggatctggctggccgcctgcaatactccttacagcgtattcaagaattggagcgggctctctgtgctgtgtctacacagcagcaggaagaggacaggtcctcgagctgcagagaagcggtcctccagcggtggttacagcagaccataaaggagcgggcgctgctgaacgcacacgtgacacaggtgacagagtcactaaaacaagtccagctagagcgagacgaatatgctaaacacataaaaggagagagggcccggtggcaggagaggatgtggaaaatgtcggtggaggctcgaacattgaaggaagagaagaagcgtgacatacatcggatacaggagctggagaggagcttgtccgaactcaaaaaccagatggctgagcccccatccctggcgcccccagcagtgacctctgtggtggaacagctacaagatgaggccaaacacctgaggcaggaggtggaaggtctggagggaaagctccagtcccaggtggaaaacaatcaggccttgagtctccttagcaaggaacaaaagcagagactccaggagcaggaggagatgctccgagagcaggaggcgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctgaacaacgagaaaaagagcgcactgcagttggagcagcaagtaaaggagctgcaggagaagctagacgaggagcacctagaagctgccagccaccagaaccaacagctagagacccagctaagcctcgtggctctccctggagaaggagatggaggacaacatctggacagtgaggaggaggaggcgcctcggcccacgccaaacatcccagaggacctggagagccgggaggccacgagcagctttatggacctcccgaaggagaaggcggacgggacggagcaggtggagagacgagagcttggattcgtccagccttctggagtgacagacggcatgagagagtccttcaccgtatatgaaagccagggggcagtgccaaacacgcggcaccaggagatggaggatgtcatcaggctggcccagaaggaggaggagatgaaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatgttttttatgaagtgagcctggacaacaacgtggagcctgcaccaggagcggccagggagggttctccccatgacaaccccactgtacagcagatcgtgcagctgtctcctgtcatgcaggacacctaggagcacccaggcttgcccagcaaaccctgcgtgccattcttctaccaggcagccgagaacagggagataaacatcatcatcttctaagagctggtcaagaaatttaaaacaacaacaacaacaaaaagttacggggttcatctcctacacaattcatttactccatttgaatgctagagccactcacatttatttgtgtttctaatttaccgtttaaatttatttgtaaaaagttaagggagagttggtctttccctgatgttctttctggcatcctttagcatttttatttttaatttgataattgtaggtcattagtatgcatatcgagtttgcccttaggtggtgggaattcaaacacacaaagacccactaatttgcacaaaactattctggctggtttggaacaggctgccatgcttttttaatgttattgcagcatgtatattcattccagaattcagataaaatgtgcttatgttctgctattacgtttgatcgaatcctaaccacagtgagctcttcattagctcaatatgtggtttgccctcaattgagcactgtttattactttgtaatatgccactgtgagtactgacatttagagttgtttaaaggccaagaactggaaacagccttttccctattttctgtgtattggggatgggagtaataacattttggggagctttttaaatctcacagaagaggaaagtggcctgctctggcaggtgtgtgcaggatagagtgtgtttcatttgttctggtgccaagaatgagcgctgtactatggtagttcccttaggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacgagtatatgtcccagtacacaaaagggcactggttggcattc

SEQ ID NO: 138451 - DNA, 2134 bp, Homo sapiens
  Payload ID: 7113
  Gene Symbol: GOLGA6B
  Gene Name: golgin A6 family, member B
  Uniprot ID: A6NDN3
  ENST ID: ENST00000421285
  CDS Start-End: 1-2082
atgtggccccaaccctacctccctccccaccccatgatgttagaagaatctcgacagaataaattggcagcagccaagaaaaagctaaaagaatatcagcaaaggaagagccctggtattccagcaggagcaaagacaaaaaagaaaaaaactgacagtagccctgagacaaccacttccggtggtggccactcacctggggatagccagtaccaagaactagcagtagccctggagtcaagctcagtgacaatcagtcaactcaatgaaaacatagaatcattgaaacagcagaagaaacaagtggaacatcagctggaagaagcaaagaaaacaaacaatgaaatacacaaagcacaaatggagcggttagagacaatcaacatcctcacattggaaaaggcagacttgaagaccaccctttaccatactaaacgtgctgcccgacacttcgaagaagagtccaaggatctggctggccgcctgcaatactccttacagcgtattcaagaattggagcgggctctctgtgctgtgtctacacagcagcaggaagaggacaggtcctcgagctgcagagaagcggtcctccaccggcggttacagcagaccataaaggagcgggcgctgctgaacgcacacgtgacacaggtgacagagtcactaaaacaagtccagctagagcgagacgaatatgctaaacacataaaaggagagagggcccggtggcaggagaggatgtggaaaatgtcggtggaggctcgaacattgaaggaagagaagaagcgtgacatacatcggatacaggagctggagaggagcttgtccgaactcaaaaaccagatggctaagcccccatccctggcgcccccagcagtgacctctgtggtggaacagctacaagatgaggccaaacacctgaggcaggaggtggaaggtctggagggaaagctccaatcccaggtggaaaacaatcaggccttgagtctccttagcaaggaacaaaagcagagactccaggagcaggaggagatgctccgagagcaggaggtgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctgaacaacgagaaaaagagcgcactgcagttggagcagcaagtaaaggagctgcaggagaagctagacgaggagcacctagaagctgccagccagcagaaccaacagctagagacccagctaagcctcgtggctctcccgggagaaggagatggaggacaacatctggacagtgaggaggaggaggcgcctcggcccacgccaaacatcccagaggacctggagagccgggaggccacgagcagctttatggacctcccgaaggagaaggcggacgggacggagcaggtggagagacgagagcttggattcgtccagccttctggagtgacagacggcatgagagagtccttcaccgtatatgaaagccagggggcagtgccaaacacgcggcaccaggagatggaggatgtcatcaggctggcccagaaggaggaggagatgaaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatgatttttatgaagtgagcctggacaacaacgtggagcctgcaccaggagcggccagggagggttctccccatgacaaccccactgtacagcagatcgtgcagctgtctcctgtcatgcaggacacctaggagcacccaggcttgcccagcaaaccctgcgtgccattcttctaccaggcag

SEQ ID NO: 138452 - DNA, 2082 bp, Homo sapiens
  Payload ID: 7114
  Gene Symbol: GOLGA6C
  Gene Name: golgin A6 family, member C
  Uniprot ID: A6NDK9
  ENST ID: ENST00000300576
  CDS Start-End: 1-2082
atgtggccccaaccctacctccctccccaccccatgatgttagaagaatctcgacagaataaattggcagcagccaagaaaaagctaaaagaatatcagcaaaggaagagccctggtattccagcaggagcaaagacaaaaaagaaaaaaactgacagtagccctgagacaaccacttccggtggtggccactcacctggggatagccagtaccaagaactagcagtagccctggagtcaagctcagtgacaatcaatcagctcaatgaaaacatagaatcattgaaacagcagaagaaacaagtggaacatcagctggaagaagcaaagaaaacaaacaatgaaatacacaaagcacaaatggagcagttagagacaatcaacatcctcacattggaaaaggcagacttgaagaccaccctttaccatactaaacgtgctgcccgacacttcgaagaagagtccaaggatctggctggccgcctgcaatactccttacagcgtattcaagaattggagcgggctctctctgctgtgtctacacagcagcaggaagaggacaggtcctcgagctgcagagaagcggtcctccagcggcggttacagcagaccataaaggagcgggcgctgctgaacgcacacgtgacacaggtgacagagtcactaaaacaagtccagctagagcgggacgaatatgctaaacacataaaaggagagagggcccggtggcaggagaggatgtggaaaatgtcggtggaggctcgaacattgaaggaagagaagaagcgtgacatacatcggatacaggagctggagaggagcttgtccgaactcaaaaaccagatggctgagcccccatccctggcacccccagcagtgacctctgtggtggaacagctacaagatgaggccaaacacctgaggcaggaggtggaaggtctggagggaaagctccagtcccaggtggaaaacaatcaggccttgagtctccttagcaaggaacaaaagcagagactccaggagcaggaggagatgctccgagagcaggaggcgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctgaacaacgagaaaaagagcgcactgcagttggagcagcaagtaaaggagctgcaggagaagctagacgaggagcacctagaagctgccagccagcggaaccaacagctagagacccagctaagcctcgtggctctccctggagaaggagatggaggacaacatctggacagtgaggaggaggaggcgcctcggcccacgccaaacatcccagaggacctggagagccgggaggccacgagcagctttatggacctcccgaaggagaaggcggacgggacggagcaggtggagagacgagagcttggattcgtccagccttctggagtgacagacggcatgagagagtccttcaccgtatatgaaagccagggggcagtgccaaacacgcggcaccaggagatggaggatgtcatcaggctggcccagaaggaggaggagatgaaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatgatttttatgaagtgagcctggacaacaacgtggagcctgcaccaggagcggccagggagggttctccccatgacaaccccccggtacagcagatcgtgcagctgtctcctgtcatgcaggacacctag

SEQ ID NO: 138453 - DNA, 2123 bp, Homo sapiens
  Payload ID: 7115
  Gene Symbol: GOLGA6D
  Gene Name: golgin A6 family, member D
  Uniprot ID: P0CG33
  ENST ID: ENST00000434739
  CDS Start-End: 42-2123
agtcacacagcagccttgtaggtgactggaggtgttcgctgatgtggccccaaccctacctccctccccaccccatgatgttagaagaatctcgacagaataaattggcagcagccaagaaaaagctaaaagaatatcagcaaaggaagagccctggtattccagcaggagcaaagacaaaaaagaaaaaaactgacagtagccctgagacaaccacttccggtggtggccactcacctggggatagccagtaccaagaactagcagtagccctggagtcaagctcagtgacaatcaatcagctcaatgaaaacatagaatcattgaaacagcagaagaaacaagtggaacatcagctggaagaagcaaagaaaacaaacaatgaaatacacaaagcacaaatggagcagttagagacaatcaacatcctcacattggaaaaggcagacttgaagaccaccctttaccatactaaacgtgctgcccgacacttcgaagaagagtccaaggatctggctggccgcctgcaatactccttacagcatattcaagaattggagcgggctctctgtgctgtgtctacacagcagcaggaagaggacaggtcctcgagctgcagagaagcggtcctccagcggcggttacagcagaccataaaggagcgggcgctgctgaacgcacacgtgacacaggtgacagagtcactaaaacaagtccagctagagcgagacgaatatgctaaacacataaaaggagagagggcccggtggcaggagaggatgtggaaaatgtcggtggaggctcgaacattgaaggaagagaagaagcgtgacatacatcggatacaggagctggagaggagcttgtccgaactcaaaaaccagatggctgagcccccatccctggcacccccagcagtgacctctgtggtggaacagctacaagatgaggccaaacacctgaggcaggaggtggaaggtctggagggaaagctccagtcccaggtggaaaacaatcaggccttgagtctccttagcaaggaacaaaagcagagactccaggagcaggaggagatgctccgagagcaggaggcgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctgaacaacgagaaaaagagcgcactgcagttggagcagcaagtaaaggagctgcaggagaagctagacgaggagcacctagaagctgccagccagcggaaccaacagctagagacccagctaagcctcgtggctctccctggagaaggagatggaggacaacatctggacagtgaggaggaggaggcgcctcggcccacgccaaacatcccagaggacctggagagccgggaggccacgagcagctttatggacctcccgaaggagaaggcggacgggacggagcaggtggagagacgagagcttggattcgtccagccttctggagtgacagacggcatgagagagtccttcaccgtatatgaaagccagggggcagtgccaaacacgcggcaccaggagatggaggatgtcatcaggctggcccagaaggaggaggagatgaaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatgttttttatgaagtgagcctggacaacaacgtggagcctgcaccaggagtggccagggagggttctccccataacaaccccactgtacagcagatcgtgcagctgtctcctgtcatgcaggacacctag

SEQ ID NO: 138454 - DNA, 3178 bp, Homo sapiens
  Payload ID: 7115
  Gene Symbol: GOLGA6D
  Gene Name: golgin A6 family, member D
  ENST ID: ENST00000618219
  CDS Start-End: 42-2123
agtcacacagcagccttgtaggtgactggaggtgttcgctgatgtggccccaaccctacctccctccccaccccatgatgttagaagaatctcgacagaataaattggcagcagccaagaaaaagctaaaagaatatcagcaaaggaagagccctggtattccagcaggagcaaagacaaaaaagaaaaaaactgacagtagccctgagacaaccacttccggtggtggccactcacctggggatagccagtaccaagaactagcagtagccctggagtcaagctcagtgacaatcaatcagctcaatgaaaacatagaatcattgaaacagcagaagaaacaagtggaacatcagctggaagaagcaaagaaaacaaacaatgaaatacacaaagcacaaatggagcagttagagacaatcaacatcctcacattggaaaaggcagacttgaagaccaccctttaccatactaaacgtgctgcccgacacttcgaagaagagtccaaggatctggctggccgcctgcaatactccttacagcgtattcaagaattggagcgggctctctctgctgtgtctacacagcagcaggaagaggacaggtcctcgagctgcagagaagcggtcctccagcggcggttacagcagaccataaaggagcgggcgctgctgaacgcacacgtgacacaggtgacagagtcactaaaacaagtccagctagagcgagacgaatatgctaaacacataaaaggagagagggcccggtggcaggagaggatgtggaaaatgtcggtggaggctcgaacattgaaggaagagaagaagcgtgacatacatcggatacaggagctggagaggagcttgtccgaactcaaaaaccagatggctgagcccccatccctggcacccccagcagtgacctctgtggtggaacagctacaagatgaggccaaacacctgaggcaggaggtggaaggtctggagggaaagctccagtcccaggtggaaaacaatcaggccttgagtctccttagcaaggaacaaaagcagagactccaggagcaggaggagatgctccgagagcaggaggcgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctgaacaacgagaaaaagagcgcactgcagttggagcagcaagtaaaggagctgcaggagaagctagacgaggagcacctagaagctgccagccagcggaaccaacagctagagacccagctaagcctcgtggctctccctggagaaggagatggaggacaacatctggacagtgaggaggaggaggcgcctcggcccacgccaaacatcccagaggacctggagagccgggaggccacgagcagctttatggacctcccgaaggagaaggcggacgggacggagcaggtggagagacgagagcttggattcgtccagccttctggagtgacagacggcatgagagagtccttcaccgtatatgaaagccagggggcagtgccaaacacgcggcaccaggagatggaggatgtcatcaggctggcccagaaggaggaggagatgaaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatgttttttatgaagtgagcctggacaacaacgtggagcctgcaccaggagtggccagggagggttctccccataacaaccccactgtacagcagatcgtgcagctgtctcctgtcatgcaggacacctaggagcacccaggcttgcccagcaaaccctgcgtgccattcttctaccaggcagccgagaacagggagataaacatcatcatcttctaagagctggtcaagaaatttaaaacaacaacaacaacaaaaagttacggggttcatctcctacacaattcatttactccatttgaatgctagagccactcacttttatttgtgtttctaatttaccgtttaaatttatttgtaaaaagttaagggagagttggtctttccctgatgttctttctggcatcctttagcatttttatttttaatttgataattgtaggtcattagtatgcatatcgagtttgcccttaggtggtgggaattcaaacacacaaagacccactaatttgcacaaaactattctggctggtttggaacaggctgccatgcttttttaatgttattgcagcatgtatattcattccagaattcagataaaatgtgcttatgttctgctattacgtttgatcgaatcctaaccacagtgagctcttcattagctcaatatgtggtttgccctcaattgagcactgtttattactttgtaatatgccactgtgagtactgacatttagagttgtttaaaggccaagaactggaaacagccttttccctattttctgtgtattggggatgggagtaataacattttggggagctttttaaatctcacagaagaggaaagtggcctgctctggcaggtgtgtgcaggatagagtgtgtttcatttgttctggtgccaagaatgagcgctgcactatggtagttcccttaggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacatgagtatatgtcccagtacacaaaagggcactggttggcattc

SEQ ID NO: 138455 - DNA, 2620 bp, Homo sapiens
  Payload ID: 7116
  Gene Symbol: GOLGA6L1
  Gene Name: golgin A6 family-like 1
  ENST ID: ENST00000614055
  CDS Start-End: 92-2098
attctagtgcagccctggttacgcctcctctggctcagtcacacagcgacgtagaggtgactggaggtatatacttgtcctcacctggatcatgctgatgtggccccaaccccacctccctacccatccccacctccctacccatccccacctccctacccatccccacctccctacccatccccacctccctacccatccccacctccctacccatccccacctccctacccatcctatgatgtccaaagaaaccagacagagcaaattggccgaggccaaggaacagttgacagaccatcatccccagaccaaccctagtgttggtacagcagcaagcgacaccaaaaagaagaaaataaataatggcactaaccctgagacaaccacttctggtggttgccactcgcctgaggatgaacagaaggcaagccaccaacatcaggaagccctaaggagggagctagaggcccaggttcataccatacgaatccttacatgtcagaaaactgagcttcagatggcactctactacagccagcatgctgtcaagcagttggaaggagaggccagggatctgatcagccgcctgcatgattcatggaagtttgcaggagagttagagcaggctctctctgctgtcgctacacagaagaagaaggcggataggtacattgaggagttaacaaaggagagggacgccctgagtctggaactgtacaggaacaccataactgatgaggagctgaaggagaaaaatgccaaactacaagaaaaacttcaacttgtagaatctgaaaagtctgagatccagctcaacgtaaaggagctaaaaaggaaactggagagggccaagctcctgctgccacagcagcagctgcaggcggaggctgaccacctgggtaaggagctgcagagtgtgtcagcaaagctccaagcccaggtggaagagaacgagttgtggaaccgcctgaaccagcaacaggaggagaagatgtggaggcaggaggagaagatacaggagtgggaggagaagatacaggagcaggaggagaagatacgggagcaggaggagaagatacgggagcaggaggagaagatgcggaggcaggaggagatgatgtgggagaaggaggagaagatgcggaggcaggaggagatgatgtgggagaaggaggagaagatgcggaggctggaggagatgatgtgggagaaggaggagaagatacgggagctggaagagaagatgcacgagcaggagaagatacgggagcaggaagagaagaggcaggaggaggagaagatacgcgagcaggagaagaggcaggagcaggaggcgaagatgtggaggcaggaggagaagatacgggagcaggaagagaagatacgggagcaggagaaaaagatgtggaggcaggaggagaagattcacgagcaggagaagatacgggaggaggagaagaggcaggagcaggaggagatgtggaggcaggaggagaagataagggagcaggaggagatatggaggcaaaaggagaagatgcacgagcaggagaagatacggaagcaggaggagaaggtgtggaggcaggaggagaagatgcacgaccaggaggagaagatacgggagcaggaggagaagatgtggaggcaggaggagaagataagggagcaggaggagaagatacgggagcaggaggagaagatacgagagcaggaggagatgatgcaggaacaggaagagaagatgggggagcaggaagagaagatgcaagaacaggagaagatgcggaggcaggaggagaagataagggagcaggaggagaagatacgggagcagaaggagaagatacgagagcaggaggagaagatatgggagcaggaggagaagatacgagagcaggaggagatgatgcaggaacaggaagagaagatgtgggagcaggaggagaagatgtgtgagcaggaagagaagatgcaagaacaggaggagaagatgcggaggcaggaggagaagatgtgggagcaggaagtgaggctgcggcagcaggaggagaagatgcaggaacaccaggagcacctggaagctgccatctaatgagcacatgacaagaaggcaaagacaataaacatgtaaaagccggcagcaaggcctggagaagagtaagccgccatgtgactgtttagaatatagtctgagcacaaacctgaaaaaaaaattttatttattttaaattgtggcaaaatactggccaggcatggtagctcacgcctgtaatcctagcaatttgggaggccgaggtaaatggatgacctgaggtcaagagttcaagaccagcctggccaatacaaaaattagccgggcatggtggcgcatgcctgtaatcccagctacttgggaggctgaggcaggagaatcgcttgaacctgggaggcagaggttgcagtgagctgagatcgtgccactgcactcaagcctgggtgacagagcgaaactccgtctcaaaaaaaaaagtttcttccttacatgtatgtttctattagttttcttcttggtctttctcatttagtcttgtgttgtcttttgacattcatagtaaacttttatctgcctccagag

SEQ ID NO: 138456 - DNA, 2620 bp, Homo sapiens; identical to SEQ ID NO: 138455
  Payload ID: 7116
  Gene Symbol: GOLGA6L1
  Gene Name: golgin A6 family-like 1
  ENST ID: ENST00000611085
  CDS Start-End: 92-2098

SEQ ID NO: 138457 - DNA, 2620 bp, Homo sapiens; identical to SEQ ID NO: 138455
  Payload ID: 7116
  Gene Symbol: GOLGA6L1
  Gene Name: golgin A6 family-like 1
  ENST ID: ENST00000616813
  CDS Start-End: 92-2098

SEQ ID NO: 138458 - DNA, 4266 bp, Homo sapiens
  Payload ID: 7117
  Gene Symbol: GOLGA6L10
  Gene Name: golgin A6 family-like 10
  ENST ID: ENST00000611944
  CDS Start-End: 63-1487
agttgcacagctgcctggtaggtgactggaggcattgagcagtgctcactggtatttcgctgatgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaagtcaatggcagtagccctgacacagccacttctggtggttaccactcacctggggattcagcaacaggtgtctacggggagggccgtgcatcctctactaccctgcaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacatgaacaggaggagaggctacatgaacaggaggagaggctgctacgtgaacaggaggagaggctgtgtgaacaggaggagaggctacgtgaacaggaggagaggctgtgtgaacaggaggagaggctatgtgaacaggaggagaggctgtgtgaacaggaggagaggctatgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcagaagaggctgcatgccattcttttcgggctgcggagaacagggagctaaacatcaccatcatctaagagcgggtcaagaaattgaaaaaaaaaaaaaacaaaacatttaaggggttaatatcctacacaattcatttacttcatttgaatgttagagccacttatgtttatttgtgtttctaatttatagtttaaatttatttgtgtttctaatttataatttaaatttatttgtgtttctaatttatagtttaaatttatttgtgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctcaagtgcgcggtctattactttgtaatatgccactgtgagtactgacatttacagttgtttaaaggtggagcactggaaacagcctttccccctttttctgtgtattggggatgggagtaataacattttggggaggtttttaaatctcccagaagaggaaagtggcctgctttggcaggtgtgtgcaggatagaatatgtttcatttgttctggtgccaagaatgagcgctgtactacggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcgggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactcaagtctttcttcaaagtgcatgcagtctcttgcagtacctcattcagccaagtatttgttctcttcctcattcagtataaggcagctttcaatttgcttagaaggcaatattagaaggttagagttcagcagaaagagagaattttaaaatgtgagttcgactgaataaatttgaatttctgtaggaagtaaagaatcaaaatacctatttaaagactgcaatatatgataattatttttaaagtaatagattaaacctgataggttttcctgaaatgaaaaacaatcagttctaaaaccaaagctgatttttagaaaatgtgaaaatgtaaatcaaccctatccaaaatagattctctaaaactttatcttacagtcactttcaaataactattcaaaaatgtaactgttaaattaatgtcttaaaataatttaaaacattttaaaatacgaatactgtagcttaaaacaaagaatctaggggaaggaaaagtagagaaagaaatgccaattccagtccaaagctgtatttgccaagttttcttagaacgacttttaccgatttatgaattcttatacacagaatgcatgatggaaatactgatttttgtctaaagtggcattattgactgcttctgtgatgctactgtaatgtaataaattattagattgtttcaaggtgctgttttgcct

SEQ ID NO: 138459 - DNA, 1705 bp, Homo sapiens
  Payload ID: 7117
  Gene Symbol: GOLGA6L10
  Gene Name: golgin A6 family-like 10
  Uniprot ID: A6NI86
  ENST ID: ENST00000610657
  CDS Start-End: 101-1669
gcgttccattggtgccctggttacgccacctgtggctcagttgcacagctgcctggtaggtgactggaggcattgagcagtgctcactggtatttcgctgatgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaagtcaatggcagtagccctgacacagccacttctggtggttaccactcacctggggattcagcaacaggtatctacggggagggccgtgcatcctctactaccctgcaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacatgaacaggaggagaggctacatgaacaggaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctacgtgaacaggaggagaggctatgtgaacaggaggagaggctgtgtgaacaggaggagaggctacgtgaacaggaggagaggctatgtgaacaggaggagaggctatgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcagaagaggctgcatgccattcttttcgggctgcggagaacagggagctaaacatcaccatcatctaagagcgggtcaagaaattgaaaaaaaaaaaaacaaaa

SEQ ID NO: 138460 - DNA, 1425 bp, Homo sapiens
  Payload ID: 7117
  Gene Symbol: GOLGA6L10
  Gene Name: golgin A6 family-like 10
  ENST ID: ENST00000618409
  CDS Start-End: 1-1425
atgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaagtcaatggcagtagccctgacacagccacttctggtggttaccactcacctggggattcagcaacaggtatctacggggagggccgtgcatcctctactaccctgcaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacatgaacaggaggagaggctacatgaacaggaggagaggctgctacgtgaacaggaggagaggctgtgtgaacaggaggagaggctacgtgaacaggaggagaggctgtgtgaacaggaggagaggctacgtgaacaggaggagaggctgtgtgaacaggaggagaggctatgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcagaagaggctgcatgccattcttttcgggctgcggagaacagggagctaaacatcaccatcatctaa

SEQ ID NO: 138461 - DNA, 4306 bp, Homo sapiens
  Payload ID: 7117
  Gene Symbol: GOLGA6L10
  Gene Name: golgin A6 family-like 10
  ENST ID: ENST00000619556
  CDS Start-End: 101-1528
gcgttccattggtgccctggttacgccacctgtggctcagttgcacagctgcctggtaggtgactggaggcattgagcagtgctcactggtatttcgctgatgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaagtcaatggcagtagccctgacacagccacttctggtggttaccactcacctggggattcagcaacaggtatctacggggagggccgtgcatcctctactaccctgcaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacatgaacaggaggagaggctacatgaacaggaggagaggctgtgtgaacaggaggaggagaggctgtgtgaacaggaggagaggctacgtgaacaggaggagaggctacgtgaacaggaggaggagaggctacgtgaacaggaggagaggctatgtgaacaggaggagaggctatgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcagaagaggctgcatgccattcttttcgggctgcggagaacagggagctaaacatcaccatcatctaagagcgggtcaagaaattgaaaaaaaaaaaaacaaaacatttaaggggttaatatcctacacaattcatttacttcatttgaatgttagagccacttatgtttatttgtgtttctaatttatagtttaaatttatttgtgtttctaatttataatttaaatttatttgtgtttctaatttatagtttaaatttatttgtgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctcaagtgcgcggtctattactttgtaatatgccactgtgagtactgacatttacagttgtttaaaggtggagcactggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatctgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcgggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactcaagtctttcttcaaagtgcatgcagtctcttgcagtacctcattcagccaagtatttgttctcttcctcattcagtataaggcagctttcaatttgcttagaaggcaatattagaaggttagagttcagcagaaagagagaattttaaaatgtgagtttgactgaataaatttgaatttctgtaggaagtaaagaatcaaaatacctatttaaagactgcaatatatgataattatttttaaagtaatagattaaacctgataggttttcctgaaatgaaaaacaatcagttctaaaaccaaagctgatttttagaaaatgtgaaaatgtaaatcaaccctatccaaaatagattctctaaaactttatcttacagtcactttcaaataactattcaaaaatgtaactgttaaattaatgtcttaaaataatttaaaacattttaaaatacgaatactgtagcttaaaacaaagaatctaggggaaggaaaagtagagaaagaaatgccaattccagtccaaagctgtatttgccaagttttcttagaacgacttttaccgatttatgaattcttatacacagaatgcatgatggaaatactgatttttgtctaaagtggcattattgactgcttctgtgatgctactgtaatgtaataaattattagattgtttcaaggtgctgttttgcct

SEQ ID NO: 138462 - DNA, 4160 bp, Homo sapiens
  Payload ID: 7117
  Gene Symbol: GOLGA6L10
  Gene Name: golgin A6 family-like 10
  ENST ID: ENST00000621197
  CDS Start-End: 63-1382
agttgcacagctgcctggtaggtgactggaggcattgagcagtgctcactggtatttcgctgatgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaagtcaatggcagtagccctgacacagccacttctggtggttaccactcacctggggattcagcaacaggtatctacggggagggccgtgcatcctctactaccctgcaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacatgaacaggaggagaggctacatgaacaggaggagaggctgtgtgaacaggaggagaggctacgtgaacaggaggagaggctgctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcagaagaggctgcatgccattcttttcgggctgcggagaacagggagctaaacatcaccatcatctaagagcgggtcaagaaattgaaaaaaaaaaaaacaaaacatttaaggggttaatatcctacacaattcatttacttcatttgaatgttagagccacttatgtttatttgtgtttctaatttatagtttaaatttatttgtgtttctaatttataatttaaatttatttgtgtttctaatttatagtttaaatttatttgtgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctcaagtgcgcggtctattactttgtaatatgccactgtgagtactgacatttacagttgtttaaaggtggagcactggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatctgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcgggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactcaagtctttcttcaaagtgcatgcagtctcttgcagtacctcattcagccaagtatttgttctcttcctcattcagtataaggcagctttcaatttgcttagaaggcaatattagaaggttagagttcagcagaaagagagaattttaaaatgtgagtttgactgaataaatttgaatttctgtaggaagtaaagaatcaaaatacctatttaaagactgcaatatatgataattatttttaaagtaatagattaaacctgataggttttcctgaaatgaaaaacaatcagttctaaaaccaaagctgatttttagaaaatgtgaaaatgtaaatcaaccctatccaaaatagattctctaaaactttatcttacagtcactttcaaataactattcaaaaatgtaactgttaaattaatgtcttaaaataatttaaaacattttaaaatacgaatactgtagcttaaaacaaagaatctaggggaaggaaaagtagagaaagaaatgccaattccagtccaaagctgtatttgccaagttttcttagaacgacttttaccgatttatgaattcttatacacagaatgcatgatggaaatactgatttttgtctaaagtggcattattgactgcttctgtgatgctactgtaatgtaataaattattagattgtttcaaggtgctgttttgcct

SEQ ID NO: 138463 - DNA, 1640 bp, Homo sapiens
  Payload ID: 7117
  Gene Symbol: GOLGA6L10
  Gene Name: golgin A6 family-like 10
  ENST ID: ENST00000633133
  CDS Start-End: 63-1631
agttgcacagctgcctggtaggtgactggaggcattgagcagtgctcactggtatttcgctgatgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaagtcaatggcagtagccctgacacagccacttctggtggttaccactcacctggggattcagcaacaggtgtctacggggagggccgtgcatcctctactaccctgcaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacatgaacaggaggagaggctacatgaacaggaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggaggagaggctatgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcagaagaggctgcatgccattcttttcgggctgcggagaacagggagctaaacatcaccatcatctaagagcgggtc

SEQ ID NO: 138464 - DNA, 1682 bp, Homo sapiens
  Payload ID: 7117
  Gene Symbol: GOLGA6L10
  Gene Name: golgin A6 family-like 10
  ENST ID: ENST00000632596
  CDS Start-End: 63-1673
agttgcacagctgcctggtaggtgactggaggcattgagcagtgctcactggtatttcgctgatgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaagtcaatggcagtagccctgacacagccacttctggtggttaccactcacctggggattcagcaacaggtatctacggggagggccgtgcatcctctactaccctgcaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacatgaacaggaggagaggctacatgaacaggaggagaggctgtgtgaacaggaggagaggctacgtgaacaggaggagaggctgtgtgaacaggaggagaggctacgtgaacaggaggagaggctacgtgaacaggaggagaggctacgtgaacaggaggagaggctacatgaacaggaggagaggctacatgaacaggaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggaggagaggctatgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcagaagaggctgcatgccattcttttcgggctgcggagaacagggagctaaacatcaccatcatctaagagcgggtc

SEQ ID NO: 138465 - DNA, 1379 bp, Homo sapiens
  Payload ID: 7118
  Gene Symbol: GOLGA6L2
  Gene Name: golgin A6 family-like 2
  Uniprot ID: Q8N9W4
  ENST ID: ENST00000312015
  CDS Start-End: 90-1334
gctgcgtggtacgtgactggaggtgtatccttgtcctcgtctgaatcacgctgatgtggccccaaccccacctccctccccaccccatgatgtcagaaaaaaccagacagaacaaattggctgaggccaagaaaaagtttacagactatcgtcagtggaacattgctggtgttggtaccagagcaactgacaccaaaaagaagaaaataaataatggcactaaccctgagacaaccacttcggagggttgccattcacctgaggatacacaacagaaccgagcgcagctgaaagaagaaaagaaggcaagccaccaacatcaggaagccctaaggcgggagatagaggcccaggatcatacaatacgaattctcacgtgtcagaaaactgaactggagacagcgctctattacagccaggatgctgccaggaaatttgaagatgggaacctgggcaccccatcatccttcaacctggcactttcacaggcctttagggggagtcctttgggctgtgtctcaacctctctcattccaggagagtccaaggatctcgccggccgcttgcatcattcctggcactttgcaggagagttacagcgggctctctctgctgtgtccacatggcacaagaaggcagacaggtacatcgaggagttaacaaaggagagggacgccctgagtctggaactgtacaggaacaccataaccaatgaggagctgaagaagaaaaatgccgaactacaagaaaaacttcgacttgcagaatctgaaaagtctgagatccagctcaacgtgaaggagctaaaaaggaaactggagagggccaagttcctgctgccacaggttcaaaccaacactttgcaggaggagatgtggaggcaggaggaggagctacgggagcaggaaaagaagatacggaagcaggaggagaagatgtggagacaggaggagagactgcgggagcaggaggggaagatgcgggagcaggaggagaagatgcggagacaggaggagatgcgagagaaggaggagaggatacgagatcagaaagagaagatgcaggagaggctgccagagcacgaggagcggtgctcagagccctgcctccctccctccaaagttctttgtaatatgagccacactggcagtgtggagcctgcaggaggagaggctggggagggttctccgcaggacaaccccactgcacaggagatcatgcagctgttttgtgggatgaagaacgcccagcagtgcccaggattaggcagtacctcctgcatcccattcttctaccgaggagacaagagaaagatgaagatcatcaatatctaaaagttggcactgtcaacaaggcctacagaagcataagccgccatg

SEQ ID NO: 138466 - DNA, 1972 bp, Homo sapiens
  Payload ID: 7118
  Gene Symbol: GOLGA6L2
  Gene Name: golgin A6 family-like 2
  ENST ID: ENST00000345070
  CDS Start-End: 781-1725
gctgcgtggtacgtgactggaggtgtatccttgtcctcgtctgaatcacgctgatgtggccccaaccccacctccctccccaccccatgatgtcagaaaaaaccagacagaacaaattggctgaggccaagaaaaagtttacagactatcgtcagtggaacattgctggtgttggtaccagagcaactgacaccaaaaagaagaaaataaataatggcactaaccctgagacaaccacttcggagggttgccattcacctgaggatgaaaagaaggcaagccaccaacatcaggaagccctaaggcgggagatagaggcccaggatcatacaatacgaattctcacgtgtcagaaaactgaactggagacagcgctctattacagccaggatgctgccaggaaatttgaagatgggaacctgggcaccccatcatccttcaacctggcactttcacaggcctttagggggagtcctttgggctgtgtctcaacctctctcattccaggagagtccaaggatctcgccggccgcttgcatcattcctggcactttgcaggagagttacagcgggctctctctgctgtgtccacatggcacaagaaggcagacaggtacatcgaggagttaacaaaggagagggacgccctgagtctggaactgtacaggaacacaatctgaaaagtctgagatccagctcaacgtgaaggagctaaaaaggaaactggagagggccaagttcctgctgccacaggttcaaaccaacactttgcaggaggagatgtggaggcaggaggaggagctacgggagcaggaaaagaagatacggaagcaggaggagaagatgtggagacaggaggagagactgcgggagcaggaggggaagatgcgggagcaggaggagaagatgcggagacaggagaagaggctgcgagagcaggagaaggagctgcgggagcaggagaaggagctgcgggagcagaagaagctgcgggagcaggaggagcagatgcaggagcaggaggagaagatgtgggagcaggaggagaagatgcgggagcaggaagagaagatgtggagacaggaggagaggctgtgggagcaggagaagcagatgcgggagcaggagcagaagatgcgggaccaagaggagaggatgtgggagcaggacgagaggctacgggagaaggaggagaggatgcgggagcaggagaagatgtgggagcaggtggagaagatgcgggaggagaagaagatgcaggagcaggagaagaagacgcgggaccaggaggagaagatgcaagaggaggagaggatacgggagcgggagaagaagatgcgggaagaggaggagacgatgcgggagcaggaggagaagatgcagaagcaggaggagaatatgtgggagcaggaagagaaggagtggcagcagcagaggctgccggaacagaaggagaagctgtgggaacaggagaagatgcaggagcaggaggagaagatatgggagcaggaggagaagatacgggaccaggaggagatgtgggggcaggagaagaagatgtggcggcaggagaagatgcgggagcaggaagatgtgggggcaggaggagatgcgagagaaggaggagaggatacgagatcagaaagagaagatgcaggagaggctgccagagcacgaggagcggtgctcagagccctgcctccctccctccaaagttctttgtaatatgagccacactggcagtgtggagcctgcaggaggagaggctggggagggttctccgcaggacaaccccactgcacaggagatcatgcagctgttttgtgggatgaagaacgcccagcagtgcccaggattaggcagtacctcctgcatcccattcttctaccgaggagacaagagaaagatgaagatcatcaatatctaaaagttggcactgtcaacaaggcctacagaagcataagccgccatg

SEQ ID NO: 138467 - DNA, 3030 bp, Homo sapiens
  Payload ID: 7118
  Gene Symbol: GOLGA6L2
  Gene Name: golgin A6 family-like 2
  ENST ID: ENST00000567107
  CDS Start-End: 54-2783
gctgcgtggtacgtgactggaggtgtatccttgtcctcgtctgaatcacgctgatgtggccccaaccccacctccctccccaccccatgatgtcagaaaaaaccagacagaacaaattggctgaggccaagaaaaagtttacagactatcgtcagtggaacattgctggtgttggtaccagagcaactgacaccaaaaagaagaaaataaataatggcactaaccctgagacaaccacttcggagggttgccattcacctgaggatacacaacagaaccgagcgcagctgaaagaagaaaagaaggcaagccaccaacatcaggaagccctaaggcgggagatagaggcccaggatcatacaatacgaattctcacgtgtcagaaaactgaactggagacagcgctctattacagccaggatgctgccaggaaatttgaagatgggaacctgggcaccccatcatccttcaacctggcactttcacaggcctttagggggagtcctttgggctgtgtctcaacctctctcattccaggagagtccaaggatctcgccggccgcttgcatcattcctggcactttgcaggagagttacagcgggctctctctgctgtgtccacatggcacaagaaggcagacaggtacatcgaggagttaacaaaggagagggacgccctgagtctggaactgtacaggaacaccataaccaatgaggagctgaagaagaaaaatgccgaactacaagaaaaacttcgacttgcagaatctgaaaagtctgagatccagctcaacgtgaaggagctaaaaaggaaactggagagggccaagttcctgctgccacaggttcaaaccaacactttgcaggaggagatgtggaggcaggaggaggagctacgggagcaggaaaagaagatacggaagcaggaggagaagatgtggagacaggaggagagactgcgggagcaggaggggaagatgcgggagcaggaggagaagatgcggagacaggagaagaggctgcgagagcaggagaaggagctgcgggagcaggagaaggagctgcgggagcagaagaagctgcgggagcaggaggagcagatgcaggagcaggaggagaagatgtgggagcaggaggagaagatgcgggagcaggaagagaagatgtggagacaggaggagaggctgtgggagcaggagaagcagatgcgggagcaggagcagaagatgcgggaccaagaggagaggatgtgggagcaggacgagaggctacgggagaaggaggagaggatgcgggagcaggagaagatgtgggagcaggtggagaagatgcgggaggagaagaagatgcaggagcaggagaagaagacgcgggaccaggaggagaagatgcaagaggaggagaggatacgggagcgggagaagaagatgcgggaagaggaggagacgatgcgggagcaggaggagaagatgcagaagcaggaggagaatatgtgggagcaggaagagaaggagtggcagcagcagaggctgccggaacagaaggagaagctgtgggaacaggagaagatgcaggagcaggaggagaagatatgggagcaggaggagaagatacgggaccaggaggagatgtgggggcaggagaagaagatgtggcggcaggagaagatgcgggagcaggaagatgtggagacaggaggagaggctgcaggagcaggagaagcagatgtgggagcaggaggagaagatgcgggatcaggagcagaagatgtgggaccaggaggagaggatgtgggagcaggacgagaggctgcgggagaaggaggagagaatgcgggagcagaagaagatgtggcagcaggaggagaagatgcgggaggagaagaagacgcaggagcaggagaagaagacatgggaccaggaggagaagatgcgagaggaggagaggatgcgggagcgggagaagaagatgcgggaggaggaggagatgatgcgggagcaggaggagaagatgcaggagcaggaagagaagatgcgggagcaggaggagaagatgtgggagcaggaagagaagatgcaggagcaggaggagaagatgtgggagcaggaggagaagatgtgggagcaggaagaagaagatgtgggagcagcagaggctgccggaacagaaggagaagctgtgggaacacgagaagatgcaggagcaggagatcaggagcagaagatgtgggaccagaaggagaggatgtgggagcaggacgagaggctgcgggagaaggaggagagaatgcgggagcagaagatgtggcagcaggtggagaagatgcgggagaagaagaagacgcaggaggagaagatgcaggagcagcaagagaagatgcaggagcaggaggagatgatgtgggagcaggaagagaagatgcaggagcaggaggagaagatgtgggagcaggaggagaagatgcgggagcaggaggagaagatgcgggagcaggaggagaagatgcagggccaggaggagaagatgcgggagcaggaggagaagatgcagggccaggaggagaagatgcgggagcaggaggagaagatgcggggccaggaggagaagatgtggggccaggaggagaagatgtgggggcaggaggagaagatgtgggggcaggaggagatgcgagagaaggaggagaggatacgagatcagaaagagaagatgcaggagaggctgccagagcacgaggagcggtgctcagagccctgcctccctccctccaaagttctttgtaatatgagccacactggcagtgtggagcctgcaggaggagaggctggggagggttctccgcaggacaaccccactgcacaggagatcatgcagctgttttgtgggatgaagaacgcccagcagtgcccaggattaggcagtacctcctgcatcccattcttctaccgaggagacaagagaaagatgaagatcatcaatatctaaaagttggcactgtcaacaaggcctacagaagcataagccgccatg

SEQ ID NO: 138468 - DNA, 2938 bp, Homo sapiens
  Payload ID: 7118
  Gene Symbol: GOLGA6L2
  Gene Name: golgin A6 family-like 2
  ENST ID: ENST00000566571
  CDS Start-End: 54-680
gctgcgtggtacgtgactggaggtgtatccttgtcctcgtctgaatcacgctgatgtggccccaaccccacctccctccccaccccatgatgtcagaaaaaaccagacagaacaaattggctgaggccaagaaaaagtttacagactatcgtcagtggaacattgctggtgttggtaccagagcaactgacaccaaaaagaagaaaataaataatggcactaaccctgagacaaccacttcggagggttgccattcacctgaggatgaaaagaaggcaagccaccaacatcaggaagccctaaggcgggagatagaggcccaggatcatacaatacgaattctcacgtgtcagaaaactgaactggagacagcgctctattacagccaggatgctgccaggaaatttgaagatgggaacctgggcaccccatcatccttcaacctggcactttcacaggcctttagggggagtcctttgggctgtgtctcaacctctctcattccaggagagtccaaggatctcgccggccgcttgcatcattcctggcactttgcaggagagttacagcgggctctctctgctgtgtccacatggcacaagaaggcagacaggtacatcgaggagttaacaaaggagagggacgccctgagtctggaactgtacaggaacacaatctgaaaagtctgagatccagctcaacgtgaaggagctaaaaaggaaactggagagggccaagttcctgctgccacaggttcaaaccaacactttgcaggaggagatgtggaggcaggaggaggagctacgggagcaggaaaagaagatacggaagcaggaggagaagatgtggagacaggaggagagactgcgggagcaggaggggaagatgcgggagcaggaggagaagatgcggagacaggagaagaggctgcgagagcaggagaaggagctgcgggagcaggagaaggagctgcgggagcagaagaagctgcgggagcaggaggagcagatgcaggagcaggaggagaagatgtgggagcaggaggagaagatgcgggagcaggaagagaagatgtggagacaggaggagaggctgtgggagcaggagaagcagatgcgggagcaggagcagaagatgcgggaccaagaggagaggatgtgggagcaggacgagaggctacgggagaaggaggagaggatgcgggagcaggagaagatgtgggagcaggtggagaagatgcgggaggagaagaagatgcaggagcaggagaagaagacgcgggaccaggaggagaagatgcaagaggaggagaggatacgggagcgggagaagaagatgcgggaagaggaggagacgatgcgggagcaggaggagaagatgcagaagcaggaggagaatatgtgggagcaggaagagaaggagtggcagcagcagaggctgccggaacagaaggagaagctgtgggaacaggagaagatgcaggagcaggaggagaagatatgggagcaggaggagaagatacgggaccaggaggagatgtgggggcaggagaagaagatgtggcggcaggagaagatgcgggagcaggaagatgtggagacaggaggagaggctgcaggagcaggagaagcagatgtgggagcaggaggagaagatgcgggatcaggagcagaagatgtgggaccaggaggagaggatgtgggagcaggacgagaggctgcgggagaaggaggagagaatgcgggagcagaagaagatgtggcagcaggaggagaagatgcgggaggagaagaagacgcaggagcaggagaagaagacatgggaccaggaggagaagatgcgagaggaggagaggatgcgggagcgggagaagaagatgcgggaggaggaggagatgatgcgggagcaggaggagaagatgcaggagcaggaagagaagatgcgggagcaggaggagaagatgtgggagcaggaagagaagatgcaggagcaggaggagaagatgtgggagcaggaggagaagatgtgggagcaggaagaagaagatgtgggagcagcagaggctgccggaacagaaggagaagctgtgggaacacgagaagatgcaggagcaggagatcaggagcagaagatgtgggaccagaaggagaggatgtgggagcaggacgagaggctgcgggagaaggaggagagaatgcgggagcagaagatgtggcagcaggtggagaagatgcgggagaagaagaagacgcaggaggagaagatgcaggagcagcaagagaagatgcaggagcaggaggagatgatgtgggagcaggaagagaagatgcaggagcaggaggagaagatgtgggagcaggaggagaagatgcgggagcaggaggagaagatgcgggagcaggaggagaagatgcagggccaggaggagaagatgcgggagcaggaggagaagatgcagggccaggaggagaagatgcgggagcaggaggagaagatgcggggccaggaggagaagatgtggggccaggaggagaagatgtgggggcaggaggagaagatgtgggggcaggaggagatgcgagagaaggaggagaggatacgagatcagaaagagaagatgcaggagaggctgccagagcacgaggagcggtgctcagagccctgcctccctccctccaaagttctttgtaatatgagccacactggcagtgtggagcctgcaggaggagaggctggggagggttctccgcaggacaaccccactgcacaggagatcatgcagctgttttgtgggatgaagaacgcccagcagtgcccaggattaggcagtacctcctgcatcccattcttctaccgaggagacaagagaaagatgaagatcatcaatatctaaaagttggcactgtcaacaaggcctacagaagcataagccgccatg

SEQ ID NO: 138469 - DNA, 2054 bp, Homo sapiens
  Payload ID: 7119
  Gene Symbol: GOLGA6L22
  Gene Name: golgin A6 family-like 22
  ENST ID: ENST00000612056
  CDS Start-End: 1-1980
atgctgatgtggccccaaccccacctccctacccatccccacctccctacccatccccacctccctacccatccccctatgatgtccaaagaaaccagacagagcaaattggccgaggccaaggaacagttgacagaccatcatccccagaccaaccctagtgttggtacagcagcaagcgacaccaaaaagaagaaaataaataatggcactaaccctgagacaaccacttctggtggttgccactcgcctgaggatgaacagaaggcaagccaccaacatcaggaagccctaaggagggagctagaggcccaggttcataccatacgaatccttacatgtcagaaaactgagcttcagatggcactctactacagccagcatgctgtcaagcagttggaaggagaggccagggatctgatcagccgcctgcatgattcatggaagtttgcaggagagttagagcaggctctctctgctgtcgctacacagaagaagaaggcggataggtacattgaggagttaacaaaggagagggacgccctgagtctggaactgtacaggaacaccataactgatgaggagctgaaggagaaaaatgccaaactacaagaaaaacttcaacttgtagaatctgaaaagtctgagatccagctcaacgtaaaggagctaaaaaggaaactggagagggccaagctcctgctgccacagcagcagctgcaggcggaggctgaccacctgggtaaggagctgcagagtgtgtcagcaaagctccaagcccaggtggaagagaacgagttgtggaaccgcctgaaccagcaacaggaggagaagatgtggaggcaggaggagaagatacaggagtgggaggagaagatacaggagcaggaggagaagatacgggagcaggaggagaagatacgggagcaggaggagaagatgcggaggcaggaggagatgatgtgggagaaggaggagaagatgcggaggcaggaggagatgatgtgggagaaggaggagaagatgcggaggcaggaggagatgatgtgggagaaggaggagaagatgcggaggctggaggagatgatgtgggagaaggaggagaagatacgggagctggaagagaagatgcacgagcaggagaagatacgggagcaggaagagaagaggcaggaggaggagaagatacgcgagcaggagaagaggcaggagcaggaggcgaagatgtggaggcaggaggagaagatacgggagcaggaagagaagatacgggagcaggagaaaaagatgtggaggcaggaggagaagattcacgagcaggagaagatacgggaggaggagaagaggcaggagcaggaggagatgtggaggcaggaggagaagataagggagcaggaggagatatggaggcaaaaggagaagatgcacgagcaggagaagatacggaagcaggaggagaaggtgtggaggcaggaggagaagatgcacgaccaggaggagaagatacgggagcaggaggagaagatgtggaggcaggaggagaagataagggagcaggaggagaagatacgggagcaggaggagaagatacgagagcaggaggagatgatgcaggaacaggaagagaagatgggggagcaggaagagaagatgcaagaacaggagaagatgcggaggcaggaggagaagataagggagcaggaggagaagatacgggagcagaaggagaagatacgagagcaggaggagaagatatgggagcaggaggagaagatacgagagcaggaggagatgatgcaggaacaggaagagaagatgtgggagcaggaggagaagatgtgtgagcaggaagagaagatgcaagaacaggaggagaagatgcggaggcaggaggagaagatgtgggagcaggaagtgaggctgcggcagcaggaggagaagatgcaggaacaccaggagcacctggaagctgccatctaatgagcacatgacaagaaggcaaagacaataaacatgtaaaagccggcagcaaggcctggagaagagtaagccgc

SEQ ID NO: 138470 - DNA, 4178 bp, Homo sapiens
  Payload ID: 7119
  Gene Symbol: GOLGA6L22
  Gene Name: golgin A6 family-like 22
  ENST ID: ENST00000622895
  CDS Start-End: 1-2433
atgatgtccaaagaaaccagacagagcaaattggccgaggccaaggaacagttgacagaccatcatccccagaccaaccctagtgttggtacagcagcaagcgacaccaaaaagaagaaaataaataatggcactagccctgagacaaccacttctggtggttgccactcgcctgaggatgaacagaaggcaagccaccaacatcaggaagccctaaggagggagctagaggcccaggttcataccatacgaatccttacatgtcagaaaactgagcttcagatggcactctactacagccagcatgctgtcaagcagttggaaggagaggccagggatctgatcagccgcctgcatgattcatggaagtttgcaggagagttagagcaggctctctctgctgtcactacacagaagaagaaggcggataggtacattgaggagttaacaaaggagagggacgccctgagtctggaactgtacaggaacaccataactgatgaggagctgaaggagaaaaatgccaaactacaagaaaaacttcaacttgtagaatctgaaaagtctgagatccagctcaacgtaaaggagctaaaaaggaaactggagagggccaagctcctgctgccacagcagctgcaggcggaggctgaccacctgggtaaggagctgcagagtgtgtcagcaaagctccaagcccaggtggaagagaacgagttgtggaaccgcctgaaccagcaacaggaggagaagatgtggaggcaggaggagaagatacaggagtgggaggagaagatacaggagcaggaggagaagatacgggagcaggaggagaagatacgggagcaggaggagaagatgcggaggcaggaggagatgatgtgggagaaggaggagaagatgcggaggcaggaggagatgatgtgggagaaggaggagaagatacgggagctggaagagaagatgcacgagcaggagaagatacgggagcaggaagagaagaggcaggaggaggagaagatacgcgagcaggagaagaggcaggagcaggaggcgaagatgtggaggcaggaggagaagatacgggagcaggaagagaagatacgggagcaggagaaaaagatgtggaggcaggaggagaagattcacgagcaggagaagatacgggaggaggagaagaggcaggagcaggaggagatgtggaggcaggaggagaagataagggagcaggaggagatatggaggcaaaaggagaagatgcacgagcaggaggagaagatacggaagcaggaggagaaggtgtggaggcaggaggagaagatgcacgaccaggaggagaagatacgggagcaggaggagaaggtgtggaggcaggaggagaagatacgggagcaggagaagaaacgggagcaggaggagaagatgtggaggcaggaggagaagatacgggagcaggaggagaagatacgggagcaggaggagatgtggagggaggaagagaagatgcatgagcaggagaagatatgggaggaggagaagaggcaggagcaggaggataagatgtggaggcaggaggagaagatacgggagcaggaggagaaggtgtggaggcaggaggagaagatacgggagcaggaggaaaagaggcaggagcaggaggagaagatgtggaagcaggaggagaagataagggagcaggaggagaagatacgggagcaggaggagaagatacgggagcaggaggagaagatacgagagcaggaggagatgatgcaggaacaggaagagaagatgggggagcaggaagagaagatgcaagaacaggagaagatgcggaggcaggaggagaagataagggagcaggaggagaagatacgggagcagaaggagaagatacgagagcaggaggagaagatatgggagcaggaggagaagatacgagagcaggaggagatgatgcaggaacaggaagagaagatgggggagcaggaggagaagatttgggagcaggaagagaagatgcaagaacaggaggagaagatgcggaggcaggaggagaagataagggagcaggagaagaagatacgggagcaggaggagaagatacgagagcaggaggagatgatgcaggaacaggaagagaagatgggggagcaggaagagaagatgcaagaacaggaggagaagatgcggaggcaggaggagaagataagggagcaggagaagaagatacgggagcaggaggagaagatacgagagcaggaggagatgatgcaggaacaggaagagaagatgtgggagcaggaggagaagatgtgtgagcaggaagagaagatgcaagaacaggaggagaagatgcggaggcaggaggagaagatgtgggagcaggaagtgaggctgcggcagcaggaggagaagatgcaggaacactaggagcacctggaagctgccatctaatgagcacatgacaagaaggcaaagacaataaacatgtaaaagccggcagcaaggcctggagaagagtaagccgccatgtgactgtttagaatatagtctgagcacaaacctgaaaaaaaaattttatttattttaaattgtggcaaaatactggccaggcatggtagctcacgcctgtaatcctagcaatttgggaggccgaggtaaatggatgacctgaggtcaagagttcaagaccagcctggccaatacaaaaattagccgggcatggtggcgcatgcctgtaatcccagctacttgggaggctgaggcaggagaatcgcttgaacctgggaggcagaggttgcagtgagctgagatcgtgccactgcactcaagcctgggtgacagagcgaaactccgtctcaaaaaaaaaagtttcttccttacatgtatgtttctattagttttcttcttggtctttctcatttagtcttgtgttgtcttttgacattcatagtaaacttttatctgcctccagagagtattgactttgagtttatggcacacaattggagtaagggcagatcgccttcatctactttgggactaagctggttcaaagcaggttttaggttttctgatggctggtctatgttttattcatctggactcccaggggtggcccttccagggtccccaccaaggtcccatctccttcctgggacccaaattctcattaggtcatttcagccctgtgagagtgccaaacattcagctaggctctccagcctcttaactaccacttcatactcagtttcttagcctcttagccctctactgttgaccaatcaccaaatgtgggaaagcactacagactgtcaggatcacctcctaggcctggtcactcaagtcctgactgaggtctccaattaccttccaacaattgtttttgattgggggcggggcacatttttatccagtttttctaactgctcttgtggggaggcgaatctgtaacaagctcctctgcctttattgaaagttgaaaaccttcatctgtcctttttttgttgttgttgagatggagtcttgcgctgttgcccaggctctagtgcaatggcacgatctctgctcactgtaacctctgcctcctgggttcaagcaattctcctgcctcagcttcccgagtagcgtgtgccaccatgcctggctaatttttttttatacctttaatagaggcaggatttcaccatgttttccaggctggtctcgagctcctgactcaggtgatctacctgcctcagcctcccaaagtgctgggattacaagtatgagccactgcatccggcccatctgtcttttaaaacatgtttttaattggaggtataatttctattagtgaaatgcacaggtctggtttacattttgatgagttttaactcatttaacattactatggaacccacctcctttgaagatacagagtatttctatcatccagaaagttctcctgtgctttcatgctgtcccgcactcccccagccagctgatgaacatgctgaggacattggtactggattctggccgccccaaaagagccactttgaccaggcttacccagcactaaatccctgcctgctctctcaaaatttccatctttaaactggttgtacctataaccctccctcatcaagtcaatagataaacaaaccctgaaaaataaacaactcttcctggcc

SEQ ID NO: 138471 - DNA, 3991 bp, Homo sapiens
  Payload ID: 7119
  Gene Symbol: GOLGA6L22
  Gene Name: golgin A6 family-like 22
  ENST ID: ENST00000620691
  CDS Start-End: 92-2242
attctagtgcagccctggttacgcctcctctggctcagtcacacagcgacgtagaggtgactggaggtatatacttgtcctcacctggatcatgctgatgtggccccaaccccacctccctacccatccccacctccctacccatccccacctccctacccatccccacctccctacccatccccacctccctacccatccccacctccctacccatcctatgatgtccaaagaaaccagacagagcaaattggccgaggccaaggaacagttgacagaccatcatccccagaccaaccctagtgttggtacagcagcaagcgacaccaaaaagaagaaaataaataatggcactagccctgagacaaccacttctggtggttgccactcgcctgaggatgaacagaaggcaagccaccaacatcaggaagccctaaggagggagctagaggcccaggttcataccatacgaatccttacatgtcagaaaactgagcttcagatggcactctactacagccagcatgctgtcaagcagttggaaggagaggccagggatctgatcagccgcctgcatgattcatggaagtttgcaggagagttagagcaggctctctctgctgtcactacacagaagaagaaggcggataggtacattgaggagttaacaaaggagagggacgccctgagtctggaactgtacaggaacaccataactgatgaggagctgaaggagaaaaatgccaaactacaagaaaaacttcaacttgtagaatctgaaaagtctgagatccagctcaacgtaaaggagctaaaaaggaaactggagagggccaagctcctgctgccacagcagcagctgcaggcggaggctgaccacctgggtaaggagctgcagagtgtgtcagcaaagctccaagcccaggtggaagagaacgagttgtggaaccgcctgaaccagcaacaggaggagaagatgtggaggcaggaggagaagatacaggagtgggaggagaagatacaggagcaggaggagaagatacgggagcaggaggagaagatacgggagcaggaggagaagatgcggaggcaggaggagatgatgtgggagaaggaggagaagatgcggaggcaggaggagatgatgtgggagaaggaggagaagatacgggagctggaagagaagatgcacgagcaggagaagatacgggagcaggaagagaagaggcaggaggaggagaagatacgcgagcaggagaagaggcaggagcaggaggcgaagatgtggaggcaggaggagaagatacgggagcaggaagagaagatacgggagcaggagaaaaagatgtggaggcaggaggagaagattcacgagcaggagaagatacgggaggaggagaagaggcaggagcaggaggagatgtggaggcaggaggagaagataagggagcaggaggagatatggaggcaaaaggagaagatgcacgagcaggaggagaagatacggaagcaggaggagaaggtgtggaggcaggaggagaagatgcacgaccaggaggagaagatacgggagcaggaggagaaggtgtggaggcaggaggagaagatacgggagcaggaggagatgtggagggaggaagagaagatgcatgagcaggagaagatatgggaggaggagaagaggcaggagcaggaggataagatgtggaggcaggaggagaagatacgggagcaggaggagaaggtgtggaggcaggaggagaagatacgggagcaggaggaaaagaggcaggagcaggaggagaagatgtggaagcaggaggagaagataagggagcaggaggagaagatacgggagcaggaggagaagatacgggagcaggaggagaagatacgagagcaggaggagatgatgcaggaacaggaagagaagatgggggagcaggaagagaagatgggggagcaggaagagaagatgcaagaacaggaggagaagatgcggaggcaggaggagaagataagggagcaggagaagaagatacgggagcaggaggagaagatacgagagcaggaggagatgatgcaggaacaggaagagaagatgtgggagcaggaggagaagatgtgtgagcaggaagagaagatgcaagaacaggaggagaagatgcggaggcaggaggagaagatgtgggagcaggaagtgaggctgcggcagcaggaggagaagatgcaggaacactaggagcacctggaagctgccatctaatgagcacatgacaagaaggcaaagacaataaacatgtaaaagccggcagcaaggcctggagaagagtaagccgccatgtgactgtttagaatatagtctgagcacaaacctgaaaaaaaaattttatttattttaaattgtggcaaaatactggccaggcatggtagctcacgcctgtaatcctagcaatttgggaggccgaggtaaatggatgacctgaggtcaagagttcaagaccagcctggccaatacaaaaattagccgggcatggtggcgcatgcctgtaatcccagctacttgggaggctgaggcaggagaatcgcttgaacctgggaggcagaggttgcagtgagctgagatcgtgccactgcactcaagcctgggtgacagagcgaaactccgtctcaaaaaaaaaagtttcttccttacatgtatgtttctattagttttcttcttggtctttctcatttagtcttgtgttgtcttttgacattcatagtaaacttttatctgcctccagagagtattgactttgagtttatggcacacaattggagtaagggcagatcgccttcatctactttgggactaagctggttcaaagcaggttttaggttttctgatggctggtctatgttttattcatctggactcccaggggtggcccttccagggtccccaccaaggtcccatctccttcctgggacccaaattctcattaggtcatttcagccctgtgagagtgccaaacattcagctaggctctccagcctcttaactaccacttcatactcagtttcttagcctcttagccctctactgttgaccaatcaccaaatgtgggaaagcactacagactgtcaggatcacctcctaggcctggtcactcaagtcctgactgaggtctccaattaccttccaacaattgtttttgattgggggcggggcacatttttatccagtttttctaactgctcttgtggggaggcgaatctgtaacaagctcctctgcctttattgaaagttgaaaaccttcatctgtcctttttttgttgttgttgagatggagtcttgcgctgttgcccaggctctagtgcaatggcacgatctctgctcactgtaacctctgcctcctgggttcaagcaattctcctgcctcagcttcccgagtagcgtgtgccaccatgcctggctaatttttttttatacctttaatagaggcaggatttcaccatgttttccaggctggtctcgagctcctgactcaggtgatctacctgcctcagcctcccaaagtgctgggattacaagtatgagccactgcatccggcccatctgtcttttaaaacatgtttttaattggaggtataatttctattagtgaaatgcacaggtctggtttacattttgatgagttttaactcatttaacattactatggaacccacctcctttgaagatacagagtatttctatcatccagaaagttctcctgtgctttcatgctgtcccgcactcccccagccagctgatgaacatgctgaggacattggtactggattctggccgccccaaaagagccactttgaccaggcttacccagcactaaatccctgcctgctctctcaaaatttccatctttaaactggttgtacctataaccctccctcatcaagtcaatagataaacaaaccctgaaaaataaacaactcttcctggcccagc

SEQ ID NO: 138472 - DNA, 3619 bp, Homo sapiens
  Payload ID: 7119
  Gene Symbol: GOLGA6L22
  Gene Name: golgin A6 family-like 22
  ENST ID: ENST00000629225
  CDS Start-End: 1-1899
atgatgtccaaagaaaccagacagagcaaattggccgaggccaaggaacagttgacagaccatcatccccagaccaaccctagtgttggtacagcagcaagcgacaccaaaaagaagaaaataaataatggcactaaccctgagacaaccacttctggtggttgccactcgcctgaggatgaacagaaggcaagccaccaacatcaggaagccctaaggagggagctagaggcccaggttcataccatacgaatccttacatgtcagaaaactgagcttcagatggcactctactacagccagcatgctgtcaagcagttggaaggagaggccagggatctgatcagccgcctgcatgattcatggaagtttgcaggagagttagagcaggctctctctgctgtcgctacacagaagaagaaggcggataggtacattgaggagttaacaaaggagagggacgccctgagtctggaactgtacaggaacaccataactgatgaggagctgaaggagaaaaatgccaaactacaagaaaaacttcaacttgtagaatctgaaaagtctgagatccagctcaacgtaaaggagctaaaaaggaaactggagagggccaagctcctgctgccacagcagctgcaggcggaggctgaccacctgggtaaggagctgcagagtgtgtcagcaaagctccaagcccaggtggaagagaacgagttgtggaaccgcctgaaccagcaacaggaggagaagatgtggaggcaggaggagaagatacaggagtgggaggagaagatacaggagcaggaggagaagatacgggagcaggaggagaagatacgggagcaggaggagaagatgcggaggcaggaggagatgatgtgggagaaggaggagaagatgcggaggcaggaggagatgatgtgggagaaggaggagaagatgcggaggcaggaggagatgatgtgggagaaggaggagaagatgcggaggctggaggagatgatgtgggagaaggaggagaagatacgggagctggaagagaagatgcacgagcaggagaagatacgggagcaggaagagaagaggcaggaggaggagaagatacgcgagcaggagaagaggcaggagcaggaggcgaagatgtggaggcaggaggagaagatacgggagcaggaagagaagatacgggagcaggagaaaaagatgtggaggcaggaggagaagattcacgagcaggagaagatacgggaggaggagaagaggcaggagcaggaggagatgtggaggcaggaggagaagataagggagcaggaggagatatggaggcaaaaggagaagatgcacgagcaggagaagatacggaagcaggaggagaaggtgtggaggcaggaggagaagatgcacgaccaggaggagaagatacgggagcaggaggagaagatgtggaggcaggaggagaagataagggagcaggaggagaagatacgggagcaggaggagaagatacgagagcaggaggagatgatgcaggaacaggaagagaagatgggggagcaggaagagaagatgcaagaacaggagaagatgcggaggcaggaggagaagataagggagcaggaggagaagatacgggagcagaaggagaagatacgagagcaggaggagaagatatgggagcaggaggagaagatacgagagcaggaggagatgatgcaggaacaggaagagaagatgtgggagcaggaggagaagatgtgtgagcaggaagagaagatgcaagaacaggaggagaagatgcggaggcaggaggagaagatgtgggagcaggaagtgaggctgcggcagcaggaggagaagatgcaggaacaccaggagcacctggaagctgccatctaatgagcacatgacaagaaggcaaagacaataaacatgtaaaagccggcagcaaggcctggagaagagtaagccgccatgtgactgtttagaatatagtctgagcacaaacctgaaaaaaaaattttatttattttaaattgtggcaaaatactggccaggcatggtagctcacgcctgtaatcctagcaatttgggaggccgaggtaaatggatgacctgaggtcaagagttcaagaccagcctggccaatacaaaaattagccgggcatggtggcgcatgcctgtaatcccagctacttgggaggctgaggcaggagaatcgcttgaacctgggaggcagaggttgcagtgagctgagatcgtgccactgcactcaagcctgggtgacagagcgaaactccgtctcaaaaaaaaaagtttcttccttacatgtatgtttctattagttttcttcttggtctttctcatttagtcttgtgttgtcttttgacattcatagtaaacttttatctgcctccagagagtattgactttgagtttatggcacacaattggagtaagggcagatcgccttcatctactttgggactaagctggttcaaagcaggttttaggttttctgatggctggtctatgttttattcatttggactcccaggggtggcccttccagggtccccaccaaggtcccatctccttcctgggacccaaattctcattaggtcatttcagccctgtgagagtgccaaacattcagctaggctctccagcctcttaactaccacttcatactcagtttcttagcctcttagccctctactgttgaccaatcaccaaatgtgggaaagcactacagactgtcaggatcacctcctaggcctggtcactcaagtcctgactgaggtctccaattaccttccaacaattgtttttgattgggggcggggcacatttttatccagtttttctaactgctcttgtggggaggcgaatctgtaacaagctcctctgcctttactgaaagttgaaaaccttcatctgtcctttttttgttgttgttgagatggagtcttgcgctgttgcccaggctctagtgcaatggcacgatctctgctcactgtaacctctgcctcctgggttcaagcaattctcctgcctcagcttcccgcgtagcgtgtgccaccatgcctggctaatttttttttatacctttaatagaggcaggatgtcaccatgttttccaggctggtctcgagctcctgactcaggtgatctacctgcctcagcctcccaaagtgctgggattacaagtatgagccactgcatccggcccatctgtcttttaaaacatgtttttaattggaggtataatttctattagtgaaatgcacaggtctggtttacattttgatgagttttaactcatttaacattactatggaacccacctcctttgaagatacagagtatttctatcatccagaaagttctcctgtgctttcatgctgtcccgcactcccccagcagctgatgaacatgctgaggacattggtactggattctggccgccccaaaagagccgctttgaccaggcttacccagcactaaatccctgcctgctctctcaaaatttccatctttaaactggttgtacctataaccctccctcatcaagtcaatagataaacaaaccctgaaaaataaacaactcttcctggcc

SEQ ID NO: 138473 - DNA, 4155 bp, Homo sapiens
  Payload ID: 7120
  Gene Symbol: GOLGA6L4
  Gene Name: golgin A6 family-like 4
  ENST ID: ENST00000422563
  CDS Start-End: 63-1379
agttgcacagctgcctggtaggtgactggaggcattgagcagtgctcactggtatttcgctgatgtggccccaaccccgcttccctccccaccccgcgatgtcagaaaaaacacaacaggggaaattggccgcagccaagaaaaagttaaaagcatattggcagaggaagagccctggcattccagcaggagctaacaggaaaaagaaaatcaatggcagtagccctgacacagccacttctggtggttaccactcacctggggattcagcaacaggtatctacggggagggccgtgcatcctctactaccctggaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggaagaggtggaggagctcctggagcaggagaggcttcggcaacaggatgagaggctgtggcagcaggagactctgcaggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctgaagaagtcgggtggagctgaagagccaagaggctccgagtctgcagcagcagccagaccagtagctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgcggagaacagggagctaaacatcaccatcatctaagagcgggtcaaggaattgaaaaaaaaaaacaaaacatttaaggggttaatatcctacacaattcatttacttcatttgaatgttagagccacttatgtttatttgtgtttctaatttatagtttaaatttatttgtgtttctaatttatagtttaaatttatttgtgtttctaatttatagtttaaatttatttgtgtttctaatttataatttaaatttatttgtaaaaagttaaatgagagtgggtgtttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgctttttgaatgttagtacagcctgtatattcattacggaattcagataaaatttccttatgttctgctgttatgtttgatcgaatcctaatcacagtgagctcttcattagctcaatatgcagtttgccctcaagtgcgcggtctattactttgtaatatgccactgtgagtactgacatttacagttgtttaaaggtggagcactggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagcgttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcgggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgaataggaatgaccttcagatagcgtttagcaactgtaaccaatctgacaataatgtgttcatcaggtacctgtggattaaatcacatactggcatatttaagatgaatgtcagtctgaaaaataaatatactatattaattcaaatacgactctttgtgtaggtattttgtcatatgtttaagaaaaagctaaagagaatggaaatcctatgacaataactcaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctctagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgcttctgtgatgctactgtaatgtaatacattattaaattgtttcaaggtgctgttttgcct

SEQ ID NO: 138474 - DNA, 4563 bp, Homo sapiens
  Payload ID: 7120
  Gene Symbol: GOLGA6L4
  Gene Name: golgin A6 family-like 4
  Uniprot ID: A6NEF3
  ENST ID: ENST00000510439
  CDS Start-End: 63-1787
agttgcacagctgcctggtaggtgactggaggcattgagcagtgctcactggtatttcgctgatgtggccccaaccccgcttccctccccaccccgcgatgtcagaaaaaacacaacaggggaaattggccgcagccaagaaaaagttaaaagcatattggcagaggaagagccctggcattccagcaggagctaacaggaaaaagaaaatcaatggcagtagccctgacacagccacttctggtggttaccactcacctggggattcagcaacaggtatctacggggagggccgtgcatcctctactaccctggaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctacgtgaacaggaggataggctacatgaacaggaggagaggctacgtgaacaggaggagaggctgtgtgaacaggaggagaggctacgtgaacatgaggagaggctgtgtgaacaggaggagaggctatgtgaacaggaggagaggctacgtgaacaggaggagaggctacatgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggaagaggtggagaagctgttagaacaggagaggcagcaggaggagcaggagaggctgctggagagggagaggctgctggaagaggtggagaagctgttagaacaggagaggcggcaggaggagcaggagaggctgctggagagggagaggctgctggacgaggtggaggagctcctggatgaggtggaggagctcctggagcaggagaggcttcggcaacaggatgagaggctgtggcagcaggagactctgcaggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctgaagaagtcgggtggagctgaagagccaagaggctccgagtctgcagcagcagccagaccagtagctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgcggagaacagggagctaaacatcaccatcatctaagagcgggtcaaggaattgaaaaaaaaaaacaaaacatttaaggggttaatatcctacacaattcatttacttcatttgaatgttagagccacttatgtttatttgtgtttctaatttatagtttaaatttatttgtgtttctaatttatagtttaaatttatttgtgtttctaatttatagtttaaatttatttgtgtttctaatttataatttaaatttatttgtaaaaagttaaatgagagtgggtgtttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgctttttgaatgttagtacagcctgtatattcattacggaattcagataaaatttccttatgttctgctgttatgtttgatcgaatcctaatcacagtgagctcttcattagctcaatatgcagtttgccctcaagtgcgcggtctattactttgtaatatgccactgtgagtactgacatttacagttgtttaaaggtggagcactggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagcgttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcgggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgaataggaatgaccttcagatagcgtttagcaactgtaaccaatctgacaataatgtgttcatcaggtacctgtggattaaatcacatactggcatatttaagatgaatgtcagtctgaaaaataaatatactatattaattcaaatacgactctttgtgtaggtattttgtcatatgtttaagaaaaagctaaagagaatggaaatcctatgacaataactcaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctctagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgcttctgtgatgctactgtaatgtaatacattattaaattgtttcaaggtgctgttttgcct

SEQ ID NO: 138475 - DNA, 670 bp, Homo sapiens
  Payload ID: 7120
  Gene Symbol: GOLGA6L4
  Gene Name: golgin A6 family-like 4
  ENST ID: ENST00000512109
  CDS Start-End: 1-585
ttaaaagcatattggcagaggaagagccctggcattccagcaggagctaacaggaaaaagaaaatcaatggcagtagccctgacacagccacttctggtggttaccactcacctggggattcagcaacaggtatctacggggagggccgtgcatcctctactaccctggaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacgggtggagctgaagagccaagaggctccgagtctgcagcagcagccagaccagtagctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgcggagaacagggagctaaacatcaccatcatctaagagcgggtcaaggaattgaaaaaaaaaaacaaaacatttaaggggttaatatcctacacaattcatttacttcatttgaatgtta

SEQ ID NO: 138476 - DNA, 4013 bp, Homo sapiens
  Payload ID: 7121
  Gene Symbol: GOLGA6L6
  Gene Name: golgin A6 family-like 6
  ENST ID: ENST00000619213
  CDS Start-End: 92-2266
attctagtgcagccctggttacgcctcctctggctcagtcacacagcgacgtagaggtgactggaggtatatacttgtcctcacctggatcatgctgatgtggccccaaccccacctccctacccatccccacctccctacccatccccacctccctacccatccccacctccctacccatccccacctccctacccatcctatgatgtccaaagaaaccagacagagcaaattggccgaggccaaggaacagttgacagaccatcatccccagaccaaccctagtgttggtacagcagcaagcgacaccaaaaagaagaaaataaataatggcactaaccctgagacaaccacttctggtggttgccactcgcctgaggatgaacagaaggcaagccatcaacatcaggaagccctaaggagggagctagaggcccaggttcataccatacgaatccttacatgtcagaaaactgagcttcagatggcactctactacagccagcatgctgtcaagcagttggaaggagaggccagggatctgatcagccgcctgcatgattcatggaagtttgcaggagagttagagcaggctctctctgctgtcgctacacagaagaagaaggcagataggtacattgaggagttaacaaaggagagggacgccctgagtctggaactgtacaggaacacgataactgatgaggagctgaaggagaaaaatgccgaactacaagaaaaacttcaacttgtagaatctgaaaagtctgagatccagctcaacgtaaaggagctaaaaaggaaactggagagggccaagctcctgctgccacagcagcagctgcaggcggaggctgaccacctgggtaaggagctgcagagtgtgtcagcaaagctccaagcccaggtggaagagaacgagttgtggaaccgcctgaaccagcaacaggaggagaagatgtggaggcaggaggagaagatacaggagtgggaggagaagatacaggagcaggaggagaagatacgggagcaggaggagaagatacgggagcaggaggagaagatgcggaggcaggaggagatgatgtgggagaaggaggagaagatgcggaggcaggaggagatgatgtgggagaaggaggagaagatgcggaggcaggaggagatgatgtgggagaaggaggagaagatacgggagctggaagagaagatgcacgagcaggagaagatacgggagcaggaagagaagaggcaggaggaggagaagatacgcgagcaggagaagaggcaggagcaggaggcgaagatgtggaggcaggaggagaagatacgggagcaggaagagaagatacgggagcaggagaaaaagatgtggaggcaggaggagaagattcatgagcaggagaagatacgggaggaggagaagaggcaggagcaggaggagatgtggaggcaggaggagaagataagggagcaggaggagatatggaggcaaaaggagaagatgcacgagcaggaggagaagatacggaagcaggaggagaaggtgtggaggcaggaggagaagatacgggagcaggaggagaagatacgggagcaggaggagaagatgtggaggcaggaggagaagatacgggagcaggaggagatgtggagggaggaagagaagatgcatgagcaggagaagatatgggaggaggagaagaggcaggagcaggaggataagatgtggaggcaggaggagaagatacgggagcaggaggagaaggtgtggaggcaggaggagaagatacgggagcaggaggaaaagaggcaggagcaggaggagaagatgtggaagcaggaggagaagataagggagcaggaggagaagatacgggagcaggaggagaagatacgggagcaggaggagaagatacgagagcaggaggagatgacgcaggaacaggaagagaagatgggggagcaggaggagaagatgtgtgagcaggaagagaagatgcaagaacaggaggagacgatgtggaggcaggaggagaagataagggagcaggagaagaagatacgggagcaggaggagaagatacgagagcaggaggagatgatgcaggaacaggaagagaagatgtgggagcaggaggagaagatgtgtgagcaggaagagaagatgcaagaacaggaggagaagatgcggaggcaggaggagaagatgtgggagcaggaagtgaggctgcggcagcaggaggagaagatgcaggaacactaggagcacctggaagctgccatctaatgagcacatgacaagaaggcaaagacaataaacatgtaaaagccggcagcaaggcctggagaagagtaagccgccatgtgactgtttagaatatagtctgagcacaaacctgaaaaaaaaattttatttattttaaattgtggcaaaatactggccaggcatggtagctcacgcctgtaatcctagcaatttgggaggccgaggtaaatggatgacctgaggtcaagagttcaagaccagcctggccaatacaaaaattagccgggcatggtggcgcatgcctgtaatcccagctacttgggaggctgaggcaggagaatcgcttgaacctgggaggcagaggttgcagtgagctgagatcgtgccactgcactcaagcctggtgacagagcgaaactccgtctcaaaaaaaaaagtttcttccttacatgtatgtttctattagttttcttcttggtctttctcatttagtcttgtgttgtcttttgacattcatagtaaacttttatctgcctccagagagtattgactttgagtttatggcacacaattggagtaagggcagatcgccttcatctactttgggactaagctggttcaaagcaggttttaggttttctgatggctggtctatgttttattcatttggactcccaggggtggcccttccagggtccccaccaaggtcccatctccttcctgggacccaaattctcattaggtcatttcagccctgtgagagtgccaaacattcagctaggctctccagcctcttaactaccacttcatactcagtttcttagcctcttagccctctactgttgaccaatcaccaaatgtgggaaagcactacagactgtcaggatcacctcctaggcctggtcactcaagtcctgactgaggtctccaattaccttccaacaattgtttttgattgggggcggggcacatttttatccagtttttctaactgctcttgtggggaggcgaatccgtaacaagctcctctgcctttactgaaagttgaaaaccttcatctgtcctttttttgttgtttttgagatggagtattgcgctgttgcccaggctctagtgcaatggcacgatctctgctcactgtaacctctgcctcctgggttcaagcaattctcctgcctcagcttcccgagtagcgtgtgccaccatgcctggctaatttttttttatacctttaatagaggcaggatttcaccatgttttccaggctggtctcgagctcctgactcaggtgatctacctgcctcagcctcccaaagtgctgggattacaagtatgagccactgcatctggcccatctgtcttttaaaacatgtttttaattggaggtataatttctattagtgaaatgcacaggtctggtttacattttgatgagttttaactcatttaacattactatggaacccacctcctttgaagatacagagtatttctatcatccagaaagttctcctgtgctttcatgctgtcccgcactcccccagcagctgatgaacatgctgaggacattggtactggattctggccgccccaaaagagccgctttgaccaggcttacccagcactaaatccctgcctgctctctcaaaatttccatctttaaactggttgtacctataaccctccctcatcaagtcaatagataaacaaaccctgaaaaataaacaactcttcctggcccagc

SEQ ID NO: 138477 - DNA, 1710 bp, Homo sapiens
  Payload ID: 7122
  Gene Symbol: GOLGA6L9
  Gene Name: golgin A6 family-like 9
  Uniprot ID: A6NEM1
  ENST ID: ENST00000620574
  CDS Start-End: 61-1359
ttgcacagctgcctggtaggtgactggaggcattgagcagtgctcactggtatttcgctgatgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaagtcaatggcagtagccctgacacagccacttctggtggttaccactcacctggggattcagcaacaggtatctacggggagggccgtgcatcctctactaccctgcaggatctggagagccagtaccaagaactagcagtagccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagaggtggagaagctgttaaaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggttgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgccgagaacagggagctaaacatcaccatcatctaagagcgggtcaagaaattgaaaaaaaaaaacaaaacatttaaggggttaatatcctacacaattcatttacttcatttgaatgttagagccacttatgtttgtgtttctaatttatagtttaaatttatttgtgtttctaatttatagtttaaatttatttgtttctaatttatagtttaaatttatttgtgtttctaatttatagtttaaatttatttgtgtttctaatttataatttaaatttatttgtaaaaagttaaatgagagtgggtctttctctcatgttcactctggcatcttttagcatttttttaatttgataattataggacgttagcatgcatatcgagt

SEQ ID NO: 138478 - DNA, 1710 bp, Homo sapiens
  Payload ID: 7122
  Gene Symbol: GOLGA6L9
  Gene Name: golgin A6 family-like 9
  Uniprot ID: A6NEM1
  ENST ID: ENST00000618348
  CDS Start-End: 61-1359
ttgcacagctgcctggtaggtgactggaggcattgagcagtgctcactggtatttcgctgatgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaaatcaatggcagtagccctgacacattcacttctggtggttaccactcacctggggattcagcaacaggtatctacggggagggccgtgcatcctctactaccctgcaggatctggagagccagtaccaagaactagcagtagccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccacagcccccagcagggccatctaagatggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtagctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgccgagaacagggagctaaacatcaccatcatctaagagcgggtcaagaaattgaaaaaaaaaaacaaaacatttaaggggttaatatcctacacaattcatttacttcatttgaatgttagagccacttatgtttgtgtttctaatttatagtttaaatttatttgtgtttctaatttatagtttaaatttatttgtttctaatttatagtttaaatttatttgtgtttctaatttatagtttaaatttatttttgtttctaatttataatttaaatttatttgtaaaaagttaaatgagagtgggtctttctctcatgttcactctggcatcttttagcatttctttaatttgataattataggacgttagcatgcatatcgagt

SEQ ID NO: 138479 - DNA, 2027 bp, Homo sapiens
  Payload ID: 7123
  Gene Symbol: GOLGA7
  Gene Name: golgin A7
  Uniprot ID: Q7Z5G4
  ENST ID: ENST00000357743
  CDS Start-End: 202-615
cgcggggcctgggccaggcggcagctaaggcccgcggtgacagcatgggtgaaggggagcggggcagaggaggccttgggctgttttcggcggcgggtgggggcgaggggctggcgggtcagagtcccgggtccaggccggggctctgactcgcggttggtgttcccccgaccccgcagcgcggggtgtcctgtcctcgccatgaggccgcagcaggcgccggtgtccggaaaggtgttcattcagcgagactacagcagtggcacacgctgccagttccagaccaagttccctgcggagctggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagttattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattatgcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagatatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaa

SEQ ID NO: 138480 - DNA, 1903 bp, Homo sapiens
  Payload ID: 7123
  Gene Symbol: GOLGA7
  Gene Name: golgin A7
  Uniprot ID: Q7Z5G4
  ENST ID: ENST00000405786
  CDS Start-End: 79-483
aggacgtaagtgacggcgaaggcggtgcgacagcagctggagggcagaggaggcggcgcggggtgtcctgtcctcgccatgaggccgcagcaggcgccggtgtccggaaaggtgttcattcagcgagactacagcagtggcacacgctgccagttccagaccaagttccctgcggagctggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagtttttagattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattatgcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagatatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttctt

SEQ ID NO: 138481 - DNA, 808 bp, Homo sapiens
  Payload ID: 7123
  Gene Symbol: GOLGA7
  Gene Name: golgin A7
  Uniprot ID: Q7Z5G4
  ENST ID: ENST00000518270
  CDS Start-End: 194-607
gcggaaggcggggtcggccctggccccgcccacatcatttcccttcctcggcccagccccacagcgcgcagcttcggcagggtggctttacggccggaggagagggtgggtcccagacctgaggtaggaggccgagctgaggggcggggaagaggctttttgcggcaggaccgcggggtgtcctgtcctcgccatgaggccgcagcaggcgccggtgtccggaaaggtgttcattcagcgagactacagcagtggcacacgctgccagttccagaccaagttccctgcggagctggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagttattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctc

SEQ ID NO: 138482 - DNA, 1984 bp, Homo sapiens
  Payload ID: 7123
  Gene Symbol: GOLGA7
  Gene Name: golgin A7
  Uniprot ID: Q7Z5G4
  ENST ID: ENST00000520817
  CDS Start-End: 159-572
tttacggccggaggagagggtgggtcccagacctgaggtaggaggccgagctgaggggcggggaagaggctttttgcggcaggacgtaagtgacggcgaaggcggtgcgacagcagctggagggcagaggaggcggcgcggggtgtcctgtcctcgccatgaggccgcagcaggcgccggtgtccggaaaggtgttcattcagcgagactacagcagtggcacacgctgccagttccagaccaagttccctgcggagctggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagttattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattatgcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagatatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaa

SEQ ID NO: 138483 - DNA, 6447 bp, Homo sapiens
  Payload ID: 7124
  Gene Symbol: GOLGA7B
  Gene Name: golgin A7 family, member B
  Uniprot ID: Q2TAP0
  ENST ID: ENST00000370602
  CDS Start-End: 66-569
cggggtcagcaccgcggagacccccctcgcccggccccgcgacagcctccgagcgcccccggatcatggccaccgaggtccacaatctgcaggagctccggcgaagtgcctcactggccaccaaggtctttatccagagagactacagcgatgggaccatctgtcagttccagaccaaattccccccagagctggacagccggatcgagcggcagctctttgaagagactgtgaagaccctcaacggattttacgcagaggctgagaagattgggggcagctcctacctcgagggctgcctggcctgcgccacggcctacttcatcttcctctgcatggagacccactatgagaaggttctcaagaagatttcccgctacatccaggagcagaatgagaagatctttgcacctcgaggcctcctacttacagaccctgtggagcgtgggatgagggttattgagatctccatctacgaggaccggtgcagcagtggcagctccagcagcggcagcagcagcggcagtggcagcagcagcggtgggggtggtggggcgggggcccggtgactggccgagagtccctgtagggaggtgtatggccggagtgagggccttgcagacctgcggcggctgcgctaccagagcacccgcttctgagtcattctttgggctcaccctgctgcccggggtgggagggagggtgacgggcctcatatttcctgtgggccatcaacctatgccccctgtccctcacccccgtctggatcagtccatttcctgacctgggggcttttccttcccgatggggctggtctgggccacacagagacagatcttcctaggaaggctggggtggggagaacacaacctaggcggcccctctcttccacagcccctctcccaaccctgcgaggggggccgaggcctgccacatagaggactcccacactgcatgacccctcatcccaaacccatatccaccaggactctttcccttgggccctgcgtcccgtggctgtctcccagtatctgttccttctcatgcccctgcagggccccggcctgtctatgatcctgcctccaccaaattcaaggtgtggggagacgggtgccgtggttgggagctgttcagcgcactcctgacctcttctagacctatggctttcctgtcctgcattcagagctagaggccagctcggccttgcgagaagcatccaactttgagactttgcaggctgccaggtgctggttggggggcacagagcctggggctctgggaggtaatatgggggtctgggaaactccgtgaagagacatagccatgcggggcctgaatctcctgaactacagccagtttcctgagattagaacctgtgtgtatgcacatgtgaatgtatgtgtgagtgcacatgtgtgtaagtgcagtgtgcgtaaatgtgtgagtctgcgtgtgttagcatgcctgtatgtgagcgcgtgtgtgagcgcatgtgtgtgcaccagtgcacaagtgtatgaatgtggacacatttataagcacacctgtgtgtgtctgagtacatgtgcacacacgtgtgcacaaatgtgcatttatatgagtgtgagtgcatgcatgtgcatgaacatgtgtgcacaagcatgtgtgtatgagtgttcatgtgtatgagtgtgtgtgtatgcaggtgagtgcatgtgtgtgtgagtgtgtttgtgtgttccccttggctgccaggccaacgactgcttctctgcatcctgctgtcttcgctacctgagggtctgtgacttcttccctgtgtgggtccagcctgaccccctgtaagtaaatgtccaaaagccccttgcccctcccctagggctaccagggaacatactctactgcatatgttctagtggaagagaagccggggttctaggaaagaagagccaaactttggtggcctttggtgccccctctcagctccccatgacaagacaacggggctgcagacactgtgtgttcagcctgcccaggggctggggctctttaaggctttgtaggtgaggtttccatggaccttcaaaggtgccagcagcctgcaggggaaaggcaaactccctccttgcaaggaaaggagatgtccagccaatgatgcccggcttctgaggcccagaggagcaggtgggatgggagcagcccctggggctggtgtcccgaagatgaaatgaagggggctgcctatctcagttggcgggaggtgttagaagtggatgtgcaagaccagccactggaggtagctctctggagtcaaagagaggcctgcttttctaccagacatgggagcagcatgtaggatacaagggcctacccagagaccagagagagtcagcctagtccttgcagcctcaggaagtcctcggcccaagtgagtcctggtccaaggatccccctggagagccgcagttcagtgggctccaccgcagcccctggccacggcctatgccctccctgggcccctgtggggctgggcattgtgtctgacctgtgcatctcccatgggagggctgggcacaggcagtgctatggccttttttttttttttctttttccaataaaagaacttgcccagcgtgaagctctgtgatgctttctctgccccgtgacgatggagggtcagttctatgctccaggaccacatgaggggatactcagctgcctgaactggacctgacatggggagcaggatgaactctgtcttcttggagcttgcagtctactgaagaggcagacacctcagcatctctaatctggaatctttggggcacttgtagccttgggtgggggaacaggttggactgaaagcgaggccaaaagtaatcaattaatgatatcaataaatcctcatttcttgagctcttcccctgggttgggtcctgttgggagctggatcacacaggtcactcagtactgaagatgagaaagtagctggatgatcacttctcggccttttggccaagatcaaatatggagaaagtagctggatgttggaacctagcagagttgtgtcttgaattttataatttattgagcacctactatgtgccagatactttgctgaaaccatatgttagagctggcaggggatttaaagatcacttgaatcctgtcacagaggtccagagagggtgggtgacttgccctaggccacacagctggttgatgataacagggcccaagcttggaacccaggtctcctgactcagtgcccactctgttaccacagggatggcacccagatgggaagctgcctgaggctgcagggaggctgggatcacaaactcaggcctgttcccagagaggggctcatcagactgtggggacaacggctccagcctcttaggtgggggctgggcagtcccctctgggtggttctcatgtttgttgtcactgccgctaagggctgcagtgagctgtgtgcagcctggactcactccctctgctggaacctgggccgtgtgtgggttgccacaagtgagcgtgttctctaatatgagggcaggttcattctgttttgggataggaagtttgttctaccccgaggccagatttgaatccaaactcagctcttctagagatgaggtcctggggagggggtgaggatttactaaacgggtaaaaccaaatctgggtgcttatctgactgagaggcattcaacccttccattttcaaatggtaatcataataataatagtagctgacgtttatttagcacttcctatgtgccaggcactaggctaagactctacataattagtcattcaattctcacagcaaccctctatggcatggattcttatttcccattttacatatggggaaactgaggctcatggacgttaagtaactgggaaattgcagatcttggctttgaatctaggcaatctgactccaaactgcaaggaagaagacagatccagcctcagaggccgcttaacagcttgagggcctcagccgtcctgggattaggatcaggcagattcccagggaaggacttggagccatgcctgggttttgaggccgggctggcacctccacttccagggcatcacgggagggtgcatgggctgtgctcgcaggcatgcgggacccagaggcagcccggtgaagggtagtgggggactcgactcactgtgggcctggggaggtgtggtttctctctgctggcttagttacaggtggtggcctgtctctccggggtctggctgtagccatgtccctgcacccaccttgccagccagggacaggccccatcaagacccaggagcagctccagcctcagccagactgtccccgaggtcccaagtgaggccccagccactcaggcatgcctcaggaagctcctgctgcacatgctcctctccctgcgccagcaccctgctgtctggcttccttcctttggccacagggcgggtgtgtgtgaaaccacagggtttacagaagctcgaggtgccactgagtggcaggattatgcactgcactcggggaatcaaaggtggagacagaaagaactatggctgttgtgacacgtcccccacggctccccggttggcagccactgccacccgcagggacttttctgtggcttccagaggtgtggggcaaaggtggagtctggtgactttctccctagggccagcccctgggctgtcgagcctgggaaactccacatccctctccacacctctagaaggactcacaatgaggggggcccagacaggaggcatcaccacctggtttgggctttaccattcacccagggataaggcaaggcaaacaccactccacatcagatctgaatttgagctctggcttcatgacactgacacatgaagactcttggagcctcagattccccagttgttaaatagggagactaatatctcacagagttgtttagacccgaggcgttcaaccttggtggcaatggatgtcaactggaagcatgaaaaatcaccaatgcctgatcctatcctcagagattctgatttaattgttttgggggacagcttgggcatcaggattttaaagagtttccctggtgattttaatgtgaaggtaaggctgagaatccctggttttgacagtacctatagcctataagcctttaatacacctctgaaaatgcctgagacctgaataagaagtttatggttccacagaagcagccagacacaaaaatgcatatgcaccatgtgattccccttatatgaaactgaaagacaggccaaactcgcctttgattgggagtcaggatcaagattaccctgggtcgggggtagcgaatggatggggacctggggggcttctgggagctcaggatgttctgtttcttgatcagagtgccagttacacggggtgctcacttcatgagaattcactgagctgtatacttaagagctgtgtatttgtctgtactggtgatatatttcaataaaattcaccagaaaagcctgttggctacaaaataggaaaagaaaggacacacttgaaattaacgttttgttaaatatctggaaatgtaacacatatgccaaacagacaactgcaactctatgttacgtgtgtgtgtgtgtgtgtgtgtgaaaatgtaatgtctgctctgctgtgggtgggccctctaaaagggaaggtccctgatgcctaagaaaatctgaaaacagcccaggttcacaccaggagttcttaacctcgacccgactgcattcaggtgcatattatgtgccgttatctgaggagagcatctacagctttcagcagattctcaaaggggtatgcaaccccctaaaaaggttaagaacaattggttttgaggagtcagtaagaaactggccatgaatgtgcttggcatgaaagagatgcttggtaatgtcggtttctttccttcctttcagagcccagccttcggaggtttccgcatgagccttctcgggcgacttctaggaggatttattcccctggcagtgccaagggcagcctgcaccaagctcacaactcttcctccaagaggatgttcaaagggcctgtcatttcagcatctgctggacagcagaacttcgcatgcaggatcctggagctgcgtcgggttttgaatcagggacaatggaggaagtgggaaactgtgaagagagtcagagggctgtgccagctgccccctttcccacccccagcaattcacttaactttcctgagtctcacctttgtcattatgagaatgtgtatatttataaataatcatctgtttctccaatgtaagatattgttattgcagaagtgatactaggacctcgttatacgatggcctcatgatgtagatttatagcaggcttcagattctggcatagaataaacagatatttatccaagggttcactgattcccgaataaatgccaggaacattcatgta

SEQ ID NO: 138484 - DNA, 6378 bp, Homo sapiens
  Payload ID: 7124
  Gene Symbol: GOLGA7B
  Gene Name: golgin A7 family, member B
  ENST ID: ENST00000596005
  CDS Start-End: 1-501
tctcctcaggtccacaatctgcaggagctccggcgaagtgcctcactggccaccaaggtctttatccagagagactacagcgatgggaccatctgtcagttccagaccaaattccccccagagctggacagccggatcgagcggcagctctttgaagagactgtgaagaccctcaacggattttacgcagaggctgagaagattgggggcagctcctacctcgagggctgcctggcctgcgccacggcctacttcatcttcctctgcatggagacccactatgagaaggttctcaagaagatttcccgctacatccaggagcagaatgagaagatctttgcacctcgaggcctcctacttacagaccctgtggagcgtgggatgagggttattgagatctccatctacgaggaccggtgcagcagtggcagctccagcagcggcagcagcagcggcagtggcagcagcagcggtgggggtggtggggcgggggcccggtgactggccgagagtccctgtagggaggtgtatggccggagtgagggccttgcagacctgcggcggctgcgctaccagagcacccgcttctgagtcattctttgggctcaccctgctgcccggggtgggagggagggtgacgggcctcatatttcctgtgggccatcaacctatgccccctgtccctcacccccgtctggatcagtccatttcctgacctgggggcttttccttcccgatggggctggtctgggccacacagagacagatcttcctaggaaggctggggtggggagaacacaacctaggcggcccctctcttccacagcccctctcccaaccctgcgaggggggccgaggcctgccacatagaggactcccacactgcatgacccctcatcccaaacccatatccaccaggactctttcccttgggccctgcgtcccgtggctgtctcccagtatctgttccttctcatgcccctgcagggccccggcctgtctatgatcctgcctccaccaaattcaaggtgtggggagacgggtgccgtggttgggagctgttcagcgcactcctgacctcttctagacctatggctttcctgtcctgcattcagagctagaggccagctcggccttgcgagaagcatccaactttgagactttgcaggctgccaggtgctggttggggggcacagagcctggggctctgggaggtaatatgggggtctgggaaactccgtgaagagacatagccatgcggggcctgaatctcctgaactacagccagtttcctgagattagaacctgtgtgtatgcacatgtgaatgtatgtgtgagtgcacatgtgtgtaagtgcagtgtgcgtaaatgtgtgagtctgcgtgtgttagcatgcctgtatgtgagcgcgtgtgtgagcgcatgtgtgtgcaccagtgcacaagtgtatgaatgtggacacatttataagcacacctgtgtgtgtctgagtacatgtgcacacacgtgtgcacaaatgtgcatttatatgagtgtgagtgcatgcatgtgcatgaacatgtgtgcacaagcatgtgtgtatgagtgttcatgtgtatgagtgtgtgtgtatgcaggtgagtgcatgtgtgtgtgagtgtgtttgtgtgttccccttggctgccaggccaacgactgcttctctgcatcctgctgtcttcgctacctgagggtctgtgacttcttccctgtgtgggtccagcctgaccccctgtaagtaaatgtccaaaagccccttgcccctcccctagggctaccagggaacatactctactgcatatgttctagtggaagagaagccggggttctaggaaagaagagccaaactttggtggcctttggtgccccctctcagctccccatgacaagacaacggggctgcagacactgtgtgttcagcctgcccaggggctggggctctttaaggctttgtaggtgaggtttccatggaccttcaaaggtgccagcagcctgcaggggaaaggcaaactccctccttgcaaggaaaggagatgtccagccaatgatgcccggcttctgaggcccagaggagcaggtgggatgggagcagcccctggggctggtgtcccgaagatgaaatgaagggggctgcctatctcagttggcgggaggtgttagaagtggatgtgcaagaccagccactggaggtagctctctggagtcaaagagaggcctgcttttctaccagacatgggagcagcatgtaggatacaagggcctacccagagaccagagagagtcagcctagtccttgcagcctcaggaagtcctcggcccaagtgagtcctggtccaaggatccccctggagagccgcagttcagtgggctccaccgcagcccctggccacggcctatgccctccctgggcccctgtggggctgggcattgtgtctgacctgtgcatctcccatgggagggctgggcacaggcagtgctatggccttttttttttttttctttttccaataaaagaacttgcccagcgtgaagctctgtgatgctttctctgccccgtgacgatggagggtcagttctatgctccaggaccacatgaggggatactcagctgcctgaactggacctgacatggggagcaggatgaactctgtcttcttggagcttgcagtctactgaagaggcagacacctcagcatctctaatctggaatctttggggcacttgtagccttgggtgggggaacaggttggactgaaagcgaggccaaaagtaatcaattaatgatatcaataaatcctcatttcttgagctcttcccctgggttgggtcctgttgggagctggatcacacaggtcactcagtactgaagatgagaaagtagctggatgatcacttctcggccttttggccaagatcaaatatggagaaagtagctggatgttggaacctagcagagttgtgtcttgaattttataatttattgagcacctactatgtgccagatactttgctgaaaccatatgttagagctggcaggggatttaaagatcacttgaatcctgtcacagaggtccagagagggtgggtgacttgccctaggccacacagctggttgatgataacagggcccaagcttggaacccaggtctcctgactcagtgcccactctgttaccacagggatggcacccagatgggaagctgcctgaggctgcagggaggctgggatcacaaactcaggcctgttcccagagaggggctcatcagactgtggggacaacggctccagcctcttaggtgggggctgggcagtcccctctgggtggttctcatgtttgttgtcactgccgctaagggctgcagtgagctgtgtgcagcctggactcactccctctgctggaacctgggccgtgtgtgggttgccacaagtgagcgtgttctctaatatgagggcaggttcattctgttttgggataggaagtttgttctaccccgaggccagatttgaatccaaactcagctcttctagagatgaggtcctggggagggggtgaggatttactaaacgggtaaaaccaaatctgggtgcttatctgactgagaggcattcaacccttccattttcaaatggtaatcataataataatagtagctgacgtttatttagcacttcctatgtgccaggcactaggctaagactctacataattagtcattcaattctcacagcaaccctctatggcatggattcttatttcccattttacatatggggaaactgaggctcatggacgttaagtaactgggaaattgcagatcttggctttgaatctaggcaatctgactccaaactgcaaggaagaagacagatccagcctcagaggccgcttaacagcttgagggcctcagccgtcctgggattaggatcaggcagattcccagggaaggacttggagccatgcctgggttttgaggccgggctggcacctccacttccagggcatcacgggagggtgcatgggctgtgctcgcaggcatgcgggacccagaggcagcccggtgaagggtagtgggggactcgactcactgtgggcctggggaggtgtggtttctctctgctggcttagttacaggtggtggcctgtctctccggggtctggctgtagccatgtccctgcacccaccttgccagccagggacaggccccatcaagacccaggagcagctccagcctcagccagactgtccccgaggtcccaagtgaggccccagccactcaggcatgcctcaggaagctcctgctgcacatgctcctctccctgcgccagcaccctgctgtctggcttccttcctttggccacagggcgggtgtgtgtgaaaccacagggtttacagaagctcgaggtgccactgagtggcaggattatgcactgcactcggggaatcaaaggtggagacagaaagaactatggctgttgtgacacgtcccccacggctccccggttggcagccactgccacccgcagggacttttctgtggcttccagaggtgtggggcaaaggtggagtctggtgactttctccctagggccagcccctgggctgtcgagcctgggaaactccacatccctctccacacctctagaaggactcacaatgaggggggcccagacaggaggcatcaccacctggtttgggctttaccattcacccagggataaggcaaggcaaacaccactccacatcagatctgaatttgagctctggcttcatgacactgacacatgaagactcttggagcctcagattccccagttgttaaatagggagactaatatctcacagagttgtttagacccgaggcgttcaaccttggtggcaatggatgtcaactggaagcatgaaaaatcaccaatgcctgatcctatcctcagagattctgatttaattgttttgggggacagcttgggcatcaggattttaaagagtttccctggtgattttaatgtgaaggtaaggctgagaatccctggttttgacagtacctatagcctataagcctttaatacacctctgaaaatgcctgagacctgaataagaagtttatggttccacagaagcagccagacacaaaaatgcatatgcaccatgtgattccccttatatgaaactgaaagacaggccaaactcgcctttgattgggagtcaggatcaagattaccctgggtcgggggtagcgaatggatggggacctggggggcttctgggagctcaggatgttctgtttcttgatcagagtgccagttacacggggtgctcacttcatgagaattcactgagctgtatacttaagagctgtgtatttgtctgtactggtgatatatttcaataaaattcaccagaaaagcctgttggctacaaaataggaaaagaaaggacacacttgaaattaacgttttgttaaatatctggaaatgtaacacatatgccaaacagacaactgcaactctatgttacgtgtgtgtgtgtgtgtgtgtgtgaaaatgtaatgtctgctctgctgtgggtgggccctctaaaagggaaggtccctgatgcctaagaaaatctgaaaacagcccaggttcacaccaggagttcttaacctcgacccgactgcattcaggtgcatattatgtgccgttatctgaggagagcatctacagctttcagcagattctcaaaggggtatgcaaccccctaaaaaggttaagaacaattggttttgaggagtcagtaagaaactggccatgaatgtgcttggcatgaaagagatgcttggtaatgtcggtttctttccttcctttcagagcccagccttcggaggtttccgcatgagccttctcgggcgacttctaggaggatttattcccctggcagtgccaagggcagcctgcaccaagctcacaactcttcctccaagaggatgttcaaagggcctgtcatttcagcatctgctggacagcagaacttcgcatgcaggatcctggagctgcgtcgggttttgaatcagggacaatggaggaagtgggaaactgtgaagagagtcagagggctgtgccagctgccccctttcccacccccagcaattcacttaactttcctgagtctcacctttgtcattatgagaatgtgtatatttataaataatcatctgtttctccaatgtaagatattgttattgcagaagtgatactaggacctcgttatacgatggcctcatgatgtagatttatagcaggcttcagattctggcatagaataaacagatatttatccaagggttcactgattcccgaataaatgccaggaacattcatgt

SEQ ID NO: 138485 - DNA, 1899 bp, Homo sapiens
  Payload ID: 7125
  Gene Symbol: GOLGA8O
  Gene Name: Golgin A8 family member O
  ENST ID: ENST00000632788
  CDS Start-End: 1-1899
atggcagaagaaactcaacacaacaaattggctgcagccaagaaaaagttaaaagaatattggcagaaaaacagacctagagttccagcaggagtgaacagaaacaggaaaacaaatggcagtatccctgagacagccacttccggtggttgccagccacctggggattcagcaacaggtttccacagggaaggccctacatcatctgctaccctgaaagatctggagagcccgtgccaagaacgagcagtagtcctggattcaacgtccgtaaaaatcagtcgactgaagaacaccatcaaatctttgaaacaacagaagaaacaagtggaacatcagctggaagaagaaaagaaagcaaacaacgagagacagaaagccgaaagggagctagaggttcaaatccagacattgatcatacagaaagaggaactaaatacggacctgtaccacatggaacgttctctcagatactttgaagaagagtccaaggacctggctgtccgcctgcaacattcattgcagtgtaaaggagagttagagagggctctgtctgctgtcatcgccacagagaagaagaaggcaaaccagttgtccagctgcagcaaagcacatacagagtgggagttagagcagtccctacaggaccaggcactgctgaaagcgcagctgacacagttgaaggagtcatttcaacaactccaattagaaagagatgagtgtgctgaacatatagaaggagagagggcccggtggcatcagaggatgagtaaaatgttgcaggagatttgcacattaaagaaagagaagcagcaagatatgcgtcgggtagaggagctggagaggagcttgtccaaactcaaaaaccagatggctgaacccttgcccccggagcccccagcagtgccctctgaggtggagctgcagcacctgaggaaggaactagagagagtggcaggagagctccagtcccaggtcaaaaacaatcagcacataagtctcctgaaccggcgacaagaagagaggattcgggaacaggaagagaggcttcggaagcaggaggagaggcttcaggagcagcacgagaagcttcggcagctggccaagccacagagcgtcttcgaggagctgaacaatgagaacaagagcacactgcagttggagcagcaagtaaaggagctacaggagaagcttggcgaggagcacctggaagcggccagccagcagaaccagcagctaacggcccagctgaacctcatggctctccctggggaaggacacggaggagaacatctggacagtgagggggaggaggcacctcagcccatgccgagtgtcccagaggacccggagagcagggaggccatgagcagctttatggaccacctgaaggagaaggcagacctgagtgagctggtgaaaaaacaagaacttcgcttcattcaatactggcaagagagatgccatcagaaaatccatcaccttttatcagaaccagggggccgtgccaaagatgcagcactgggaggaggacaccatcaggctggagctcagggaggagatgaaggtgaagctgctggagctgcagcagatggtattgcggcttacagcaactacaacaatgggcacagaaaattcctggccgctgcccacaactctgctgatgagcccggtccaggagccccagccccccaggagcttggggctgcagacaagcatggtgatcttcgtgaggtgaccctcacctcctctgcccaaggagaggccagggaggatcctctccttgacaagcctactgcacagccgatcgtgcaggaccaccaggagcacccaggcttgggcagcaactgctgtgtgccattattttgttgggcttggctgccaagaagaaggagataa

SEQ ID NO: 138486 - DNA, 1877 bp, Homo sapiens
  Payload ID: 7126
  Gene Symbol: GOLGA8A
  Gene Name: golgin A8 family, member A
  Uniprot ID: A7E2F4
  ENST ID: ENST00000359187
  CDS Start-End: 66-1877
gttgatcagcgctcgctgggatttggctgacgtggccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggcttcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcgtgcagctccttggtgagatgcaggaccaccaggagcacccaggcttgggcagcaactgctgtgtgccatgcttttgctgggcttggctgccgagaagaaggagataa

SEQ ID NO: 138487 - DNA, 4577 bp, Homo sapiens
  Payload ID: 7126
  Gene Symbol: GOLGA8A
  Gene Name: golgin A8 family, member A
  Uniprot ID: A7E2F4
  ENST ID: ENST00000432566
  CDS Start-End: 342-2237
tgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccgagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcagtgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattccaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgc

SEQ ID NO: 138488 - DNA, 4335 bp, Homo sapiens
  Payload ID: 7127
  Gene Symbol: GOLGA8B
  Gene Name: golgin A8 family, member B
  Uniprot ID: A8MQT2
  ENST ID: ENST00000342314
  CDS Start-End: 99-1910
agttacgcagctgtcttccaggtgactggatgtgttgatcagcgctcgctgggatttggctgacgtggccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggcttcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcctgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtgcctctcactgatgttcactctggcatcctttagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgttcattacagaattcagataaaatttgctaatgttctgctatgatgtttgatctcatcttaatcacagtgagctcttccatagctcaatatgcggtttgccctcaagtgtgcactgtttattactttgtaatatgccactatgagtactgacacttagagctgtttaaaggccgagaactggaaacagcctttcctccattttctgtgtattggtgatgggagtgataaccttttgggggagctttctaaatctcgcagaagaggaaagtggcctgctctggcaggtatgtgcaggatacagtgtgtttcatctgttccggtgccaagaatgagcactgtactgtggcagttccctttggatttgtatgtgctctgggctcatgaagatattgcatcgtgagctgcagcagttgcactctttttcagtgacctaaaaatggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagacatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaaataataacaaacattattataaactaatatatgtgagagtacttagttgaaacaaaaaggaattttagtagacagtattatattatctttgaaaatcaaggagaagtttatgcaactgaaaatgtttacacactgtgctgcaatctactgtttgtgaatgtcaatgtattatcaggaaacatgtctatacgatcgcagagttgtatttcctcacaaacttctttacgaagagtgaaatatgtttttgtacctctcagtttcagtcagggacatattttgtgcaatatttctgtgattgtgcctatgcgtgatgagtgaatgcatttcaatcatacattgcctaaatcataacttgatgatgcttgggaaagaatcaacagttaaaacttcatgaagttctaatgtctgtgttccaaaacacatcacattattaggttgtagggagatatgtatgtgtgctccctggggtggggagttttctagttactagaccatctccatttttagcacttggcagcctcatgatccttttataaataggagattaacaggagagcagcaatacgattttgccaatggaataacagatttgccggcattcactgaaagagggcagatattgggtccttgtgacttcaactgactcttccgaattgtatgaatttatcaatgtattagataaacccagtttcagaataataaagaaaaaatattagaccaaataatgtggctaatagtggtatgatttctagcccgtgggtttaaaactgtatcctaaagagtcattttaaaataatataaatatttaaaagtgtaactgctatctttatgttctgaaataagttaaaacattttaaaatatgaatactgtagtttaaaagaaagaaatggtgggaaggaaaagtagagaaagaaatgccaattccagtccaaagctttgtttgccaagttttcttagaatgaattttaccaatgtatgggttcttgttaacagaatgtgtaacagaaatactgaaagacttttgcctaaagtggcattattgactgctggtgtgatgctactgtaatgtgataaattattaaattgttgcaaagtgctgtttttgccttaaaattttattttgcgcatcttgaaaattatagtattaaaggtattgatactgtgcaaa

SEQ ID NO: 138489 - DNA, 4252 bp, Homo sapiens
  Payload ID: 7127
  Gene Symbol: GOLGA8B
  Gene Name: golgin A8 family, member B
  ENST ID: ENST00000438958
  CDS Start-End: 1-1902
atgttgccagttgatggggaagaaaggaagtcggagggctcagacactgagggggacagaacatctccatgtgcaggccctacatcatctgctaccctgaaggatctggaggtaggaggctctgggtggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcctgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtgcctctcactgatgttcactctggcatcctttagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgttcattacagaattcagataaaatttgctaatgttctgctatgatgtttgatctcatcttaatcacagtgagctcttccatagctcaatatgcggtttgccctcaagtgtgcactgtttattactttgtaatatgccactatgagtactgacacttagagctgtttaaaggccgagaactggaaacagcctttcctccattttctgtgtattggtgatgggagtgataaccttttgggggagctttctaaatctcgcagaagaggaaagtggcctgctctggcaggtatgtgcaggatacagtgtgtttcatctgttccggtgccaagaatgagcactgtactgtggcagttccctttggatttgtatgtgctctgggctcatgaagatattgcatcgtgagctgcagcagttgcactctttttcagtgacctaaaaatggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagacatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaaataataacaaacattattataaactaatatatgtgagagtacttagttgaaacaaaaaggaattttagtagacagtattatattatctttgaaaatcaaggagaagtttatgcaactgaaaatgtttacacactgtgctgcaatctactgtttgtgaatgtcaatgtattatcaggaaacatgtctatacgatcgcagagttgtatttcctcacaaacttctttacgaagagtgaaatatgtttttgtacctctcagtttcagtcagggacatattttgtgcaatatttctgtgattgtgcctatgcgtgatgagtgaatgcatttcaatcatacattgcctaaatcataacttgatgatgcttgggaaagaatcaacagttaaaacttcatgaagttctaatgtctgtgttccaaaacacatcacattattaggttgtagggagatatgtatgtgtgctccctggggtggggagttttctagttactagaccatctccatttttagcacttggcagcctcatgatccttttataaataggagattaacaggagagcagcaatacgattttgccaatggaataacagatttgccggcattcactgaaagagggcagatattgggtccttgtgacttcaactgactcttccgaattgtatgaatttatcaatgtattagataaacccagtttcagaataataaagaaaaaatattagaccaaataatgtggctaatagtggtatgatttctagcccgtgggtttaaaactgtatcctaaagagtcattttaaaataatataaatatttaaaagtgtaactgctatctttatgttctgaaataagttaaaacattttaaaatatgaatactgtagtttaaaagaaagaaatggtgggaaggaaaagtagagaaagaaatgccaattccagtccaaagctttgtttgccaagttttcttagaatgaattttaccaatgtatgggttcttgttaacagaatgtgtaacagaaatactgaaagacttttgcctaaagtggcattattgactgctggtgtgatgctactgtaatgtgataaattattaaattgttgcaaa

SEQ ID NO: 138490 - DNA, 2009 bp, Homo sapiens
  Payload ID: 7128
  Gene Symbol: GOLGA8F
  Gene Name: golgin A8 family, member F
  ENST ID: ENST00000532622
  CDS Start-End: 63-2009
agtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgaggtccgtaaaagtcagtcaactgaagaacaccatcaaatctttgaaacaacagaataaacaagtggaacatcagctggaagaagaaaagaaagcaaacaacgagaaacagaaagccgaaagggagctagaggttcaaatccagagattgaacatacagaaagggaaactaaatacggacctgtaccacacgaaacgttctctcagatactttgaagaagagtccaaggatctggccgtccgtctgcaacattcattgcagcgtaaaggagagttagagcgggctctctctgctgtcaccgccacacagaagaagaaggcggagaggcagttctccagccgcagtaaagcacgtatggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagaagctggagaggagcttgtccaaactcaaacaccagatggctgaacctctgcccccggagcccccagcagtgccctctgaggtggagctgcagcacctgaggaaggaactagagagagtggcaggagagctccaggcccaggtggagtacaatcagcgcataagtctcctgaatgaggggcaaaaggagaggcttcgggagcaggaggagaggcttcaggagcagcaggagaggcttccagagcaggaggagaggcttcagcagctggccgagccacagaacagcttcaaggagctgaacaatgagaacaagagcgtactacagttggagcagcaagtaaaggagctgcaggagaagctaggcaaggagcgtctggaagctgcgagccagcagaaacagcagctaacggcccagttgagcctcatggctctccctggggaaggagatggaggaggacatctggacagtgagggggaggaggcacctcggcccattcctagcatcccacaggacctggagagcagggaggccatgagcggctttatggaccacctggaggagaaggcagacctgagtgagctggtggagaaagaagaacttggattcttccagtactacagagagagatgccatcagaaagtttatcaccctataacaaagccagggggcagtgccaaagatgcagcaccgggaggaggacaccatcaggctggccctggacagggaggagatgaaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtgatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataa

SEQ ID NO: 138491 - DNA, 5237 bp, Homo sapiens
  Payload ID: 7128
  Gene Symbol: GOLGA8F
  Gene Name: golgin A8 family, member F
  Uniprot ID: Q08AF8
  ENST ID: ENST00000526619
  CDS Start-End: 990-2282
agtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgaggtccgtaaaagtcagtcaactgaagaacaccatcaaatctttgaaacaacagaataaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtccctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggttcaaatccagagattgaacatacagaaagggaaactaaatacggacctgtaccacacgaaacgttctctcagatactttgaagaagagtccaaggatctggccgtccgtctgcaacattcattgcagcgtaaaggagagttagagcgggctctctctgctgtcaccgccacacagaagaagaaggcggagaggcagttctccagccgcagtaaagcacgtatggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagaagctggagaggagcttgtccaaactcaaacaccagatggctgaacctctgcccccggagcccccagcagtgccctctgaggtggagctgcagcacctgaggaaggaactagagagagtggcaggagagctccaggcccaggtggagtacaatcagcgcataagtctcctgaatgaggggcaaaaggagaggcttcgggagcaggaggagaggcttcaggagcagcaggagaggcttccagagcaggaggagaggcttcagcagctggccgagccacagaacagcttcaaggagctgaacaatgagaacaagagcgtactacagttggagcagcaagtaaaggagctgcaggagaagctaggcaaggagcgtctggaagctgcgagccagcagaaacagcagctaacggcccagttgagcctcatggctctccctggggaaggagatggaggaggacatctggacagtgagggggaggaggcacctcggcccattcctagcatcccacaggacctggagagcagggaggccatgagcggctttatggaccacctggaggagaaggcagacctgagtgagctggtggagaaagaagaacttggattcttccagtactacagagagagatgccatcagaaagtttatcaccctataacaaagccagggggcagtgccaaagatgcagcaccgggaggaggacaccatcaggctggccctggacagggaggagatgaaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtgatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataaacatcaccatcgtcaaagagctgctgaagaaatttttaaaaaagaaacaaagttatggggttaatctcctacacaattcatttacttcatttgaatgttatagccacttatgattatttgtgtttctaatttatagtttaagttcatttgtaaatagttaaaagagagtgggtctctgtggctttcactgatgttcactctggcatactttcgcaattttctttttcaatttcataattgtaggtcattagcatgcatattgagtttgcccttacgtggtgggagttcaaacacacaaagacccactatttgcacaaaactattcttgctggtttggaataggctgccatgtgtttttaatgttattgcagcatgtatattcattacagaattcagataaaatgtgcctatgttctgctgttgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagcttcagcagttgtactcttttttgatgacctaaaaagggcttatttctgaggaatgaaaggttcccatcattgactacggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcataagaaatcctttaagagttcaaatgtccctggaacaggcatacaagctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcatttggcatcctcatgatacttttataaatacgacattaacaggagagcagcagtacgattttgccgatggaataacagatttgccggcaatcactgaaagagtgcaaacatcgggtccttgtgacttcaacggactcttccaaattgtatgaatgtatcaatgtattagataaacccagtttcagaatgataaagaaaaaatgttagaccaaataatgcggctagttaacagtggtacgatttctcgcccgtggctttaaaatgcacttaaagtcctgtccttgccttttattttctgaacttgatgtttttgcattctttgagttcagtttaaagacaactacgagcatctgtaaccaatctgacaataatgtgttcatcaggtgcctgtggattaaatcacatactggcatatttaagctgaatgtcaatctggaaaataaattgactgtattaacggaaataccactctttgtgtagatatttgtcgtatatttaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagagggcaacattggaaggttagagttcatcagaaacagaattctaaaatgtgagttcaattcaataaatttgaatttctgtaggaagaatcaaatcaccgatttaaagattgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaacagtcattttaaaataactattaaacaatgtaactgctatcttaatgttctgaaataagttaaaacattttaaaatatgaatactgtaaaggaaataaacggtgggaaggaaaagtagagaaagaaatgccaattccagtccaaagctttatttgccaagttttcttagaatgaattttaccaatttatgaattcttgtaagcggaatgtaaaacggaaatactgaaagacttttgcctaaagtggcattattgactgctggtgtgatgctactgtaatgtaataaattattaagttgttgc

SEQ ID NO: 138492 - DNA, 5237 bp, Homo sapiens
  Payload ID: 7128
  Gene Symbol: GOLGA8F
  Gene Name: golgin A8 family, member F
  ENST ID: ENST00000618263
  CDS Start-End: 990-2282
agtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgaggtccgtaaaagtcagtcaactgaagaacaccatcaaatctttgaaacaacagaataaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtccctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggttcaaatccagagattgaacatacagaaagggaaactaaatacggacctgtaccacacgaaacgttctctcagatactttgaagaagagtccaaggatctggccgtccgtctgcaacattcattgcagcgtaaaggagagttagagcgggctctctctgctgtcaccgccacacagaagaagaaggcggagaggcagttctccagccgcagtaaagcacgtatggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagaagctggagaggagcttgtccaaactcaaacaccagatggctgaacctctgcccccggagcccccagcagtgccctctgaggtggagctgcagcacctgaggaaggaactagagagagtggcaggagagctccaggcccaggtggagtacaatcagcgcataagtctcctgaatgaggggcaaaaggagaggcttcgggagcaggaggagaggcttcaggagcagcaggagaggcttccagagcaggaggagaggcttcagcagctggccgagccacagaacagcttcaaggagctgaacaatgagaacaagagcgtactacagttggagcagcaagtaaaggagctgcaggagaagctaggcaaggagcgtctggaagctgccagccagcagaaccagcagctaacggcccagttgagcctcatggctctccctggggaaggagatggaggaggacatctggacagtgagggggaggaggcacctcggcccattcctagcatcccacaggacctggagagcagggaggccatgagcggctttatggaccacctggaggagaaggcagacctgagtgagctggtggagaaagaagaacttggattcttccagtactacagagagagatgccatcagaaagtttatcaccctataacaaagccagggggcagtgccaaagatgcagcaccgggaggaggacaccatcaggctggccctggacagggaggagatgaaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtgatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataaacatcaccatcgtcaaagagctgctgaagaaatttttaaaaaagaaacaaagttatggggttaatctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcataattgtaggtcattagcatgcatattgagtttgcccttacgtggtgggagttcaaacacacaaagacccactatttgcacaaaactattcttgctggtttggaataggctgccatgtgtttttaatgttattgcagcatgtatattcattacagaattcagataaaatgtgcctatgttctgctgttgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagcttcagcagttgtactcttttttgatgacctaaaaagggcttatttctgaggaatgaaaggttcccatcattgactacggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctttaagagttcaaatgtccctggaacaggcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcatttggcatcctcatgatacttttataaatacgacattaacaggagagcagcagtacgattttgccgatggaataacagatttgccggcaatcactgaaagagtgcaaacatcgggtccttgtgacttcaacggactcttccaaattgtatgaatgtatcaatgtattagataaacccagtttcagaatgataaagaaaaaatgttagaccaaataatgcggctagttaacagtggtacgatttctcgcccgtggctttaaaatgcacttaaagtcctgtccttgccttttattttctgaacttgatgtttttgcattctttgagttcagtttaaagacaactacgagcatctgtaaccaatctgacaataatgtgttcatcaggtgcctgtggattaaatcacatactggcatatttaagctgaatgtcaatctggaaaataaattgactgtattaacggaaataccactctttgtgtagatatttgtcgtatattgaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagagggcaacattggaaggttagagttcatcagaaacagaattctaaaatgtgagttcaattcaataaatttgaatttctgtaggaagaatcaaatcaccgatttaaagattgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaacggtgggaaggaaaagtagagaaagaaatgccaattccagtccaaagctttatttgccaagttttcttagaatgaattttaccaatttatgaattcttgtaagcggaatgtaaaacggaaatactgaaagacttttgcctaaagtggcattattgactgctggtgtgatgctactgtaatgtaataaattattaagttgttgc

SEQ ID NO: 138493 - DNA, 2009 bp, Homo sapiens
  Payload ID: 7128
  Gene Symbol: GOLGA8F
  Gene Name: golgin A8 family, member F
  ENST ID: ENST00000615448
  CDS Start-End: 63-2009
agtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgaggtccgtaaaagtcagtcaactgaagaacaccatcaaatctttgaaacaacagaataaacaagtggaacatcagctggaagaagaaaagaaagcaaacaacgagaaacagaaagccgaaagggagctagaggttcaaatccagagattgaacatacagaaagggaaactaaatacggacctgtaccacacgaaacgttctctcagatactttgaagaagagtccaaggatctggccgtccgtctgcaacattcattgcagcgtaaaggagagttagagcgggctctctctgctgtcaccgccacacagaagaagaaggcggagaggcagttctccagccgcagtaaagcacgtatggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagaagctggagaggagcttgtccaaactcaaacaccagatggctgaacctctgcccccggagcccccagcagtgccctctgaggtggagctgcagcacctgaggaaggaactagagagagtggcaggagagctccaggcccaggtggagtacaatcagcgcataagtctcctgaatgaggggcaaaaggagaggcttcgggagcaggaggagaggcttcaggagcagcaggagaggcttccagagcaggaggagaggcttcagcagctggccgagccacagaacagcttcaaggagctgaacaatgagaacaagagcgtactacagttggagcagcaagtaaaggagctgcaggagaagctaggcaaggagcgtctggaagctgccagccagcagaaccagcagctaacggcccagttgagcctcatggctctccctggggaaggagatggaggaggacatctggacagtgagggggaggaggcacctcggcccattcctagcatcccacaggacctggagagcagggaggccatgagcggctttatggaccacctggaggagaaggcagacctgagtgagctggtggagaaagaagaacttggattcttccagtactacagagagagatgccatcagaaagtttatcaccctataacaaagccagggggcagtgccaaagatgcagcaccgggaggaggacaccatcaggctggccctggacagggaggagatgaaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtgatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataa

SEQ ID NO: 138494 - DNA, 2009 bp, Homo sapiens; identical to SEQ ID NO: 138490
  Payload ID: 7129
  Gene Symbol: GOLGA8G
  Gene Name: golgin A8 family, member G
  ENST ID: ENST00000525590
  CDS Start-End: 63-2009

SEQ ID NO: 138495 - DNA, 2009 bp, Homo sapiens; identical to SEQ ID NO: 138490
  Payload ID: 7129
  Gene Symbol: GOLGA8G
  Gene Name: golgin A8 family, member G
  Uniprot ID: Q08AF8
  ENST ID: ENST00000612831
  CDS Start-End: 63-2009

SEQ ID NO: 138496 - DNA, 1947 bp, Homo sapiens
  Payload ID: 7129
  Gene Symbol: GOLGA8G
  Gene Name: golgin A8 family, member G
  ENST ID: ENST00000619115
  CDS Start-End: 1-1947
atgtggccccaagcccgcctccctccccaccctgcgatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgaggtccgtaaaagtcagtcaactgaagaacaccatcaaatctttgaaacaacagaataaacaagtggaacatcagctggaagaagaaaagaaagcaaacaacgagaaacagaaagccgaaagggagctagaggttcaaatccagagattgaacatacagaaagggaaactaaatacggacctgtaccacacgaaacgttctctcagatactttgaagaagagtccaaggatctggccgtccgtctgcaacattcattgcagcgtaaaggagagttagagcgggctctctctgctgtcaccgccacacagaagaagaaggcggagaggcagttctccagccgcagtaaagcacgtatggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagaagctggagaggagcttgtccaaactcaaacaccagatggctgaacctctgcccccggagcccccagcagtgccctctgaggtggagctgcagcacctgaggaaggaactagagagagtggcaggagagctccaggcccaggtggagtacaatcagcgcataagtctcctgaatgaggggcaaaaggagaggcttcgggagcaggaggagaggcttcaggagcagcaggagaggcttccagagcaggaggagaggcttcagcagctggccgagccacagaacagcttcaaggagctgaacaatgagaacaagagcgtactacagttggagcagcaagtaaaggagctgcaggagaagctaggcaaggagcgtctggaagctgcgagccagcagaaacagcagctaacggcccagttgagcctcatggctctccctggggaaggagatggaggaggacatctggacagtgagggggaggaggcacctcggcccattcctagcatcccacaggacctggagagcagggaggccatgagcggctttatggaccacctggaggagaaggcagacctgagtgagctggtggagaaagaagaacttggattcttccagtactacagagagagatgccatcagaaagtttatcaccctataacaaagccagggggcagtgccaaagatgcagcaccgggaggaggacaccatcaggctggccctggacagggaggagatgaaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtgatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataa

SEQ ID NO: 138497 - DNA, 1899 bp, Homo sapiens
  Payload ID: 7130
  Gene Symbol: GOLGA8H
  Gene Name: golgin A8 family, member H
  Uniprot ID: P0CJ92
  ENST ID: ENST00000566740
  CDS Start-End: 1-1899
atggcagaagaaactcaacacaacaaattggctgcagccaagaaaaagttaaaagaatattggcagaaaaacagccctagagttccagcaggagcgaacaggaacaggaaaacaaatggcagtgtccctgagaaagccacttctggtggttgccagccacctggggattcagcaacaggtttccacagggaaggccctacatcatctgctaccctgaaagatctggagagcccgtgccaagaacgagcagtagtcctggattcaaggtccgtagaaatcagtcaactgaagaacaccatcaaatctctgaaacaacagaagaaacaagtggaacatcagctggaagaagaaaagaaagcaaacaacaagaaacagaaagccaaaagggtgctagaggttcaaatccagacattgaacatacagaaagggaaactaaatacggacctgtaccacatgaaacgttctctcagatactttgaagaaaagtccaaggatctggctgtctgcctgcaacattcattgcagcgtaaaggagagttagagagtgttctctctaatgtcatggccacacagaagaagaaggcaaaccagttgtccagccgcagcaaagcacgtacggagtggaagttagagcagtccatgcgggaggaggcactactgaaagtgcagctgacacagttgaaggagtcatttcaacaagtccaattagaaagagatgagtgtgctgaacatctaaaaggagagagggcccggtggcagcagaggatgagaaaaatgtcgcaggagatttgcacattaaagaaagagaagcagcaagatatgcgtcgggtagagaagctggagaggagcttgtccaaactcaaaaaccagatggctgaacccttgcccccggagcccccagcagtgccctctgaggtggagctgcagcacctgaggaaggaactagagagagtggcaggagagctccaggcccaggtcaaaaagaatcagcgcataagtctcctgaaccagcgacaagaagagaggattcaggagcaggaagagaggcttcggaagcaggaggagaggattcaggagcagcacaagagccttcagcagctggccaagccacagagcgtcttcgaggagccgaacaatgagaacaagaacgcactgcagttggagcagcaagtaaaggagctacaggagaagcttggcgaggagcacctggaagctgccagccagcagaaccagcagctaacggcccagctgagcctcatggctctccctggggaaggacacggaggagaacatctggacagtgagggggaggaggcacctcggcccatgccgagtgtcccagaggacccggagagcagggaggccatgagcagctttatggaccacctggaggagaaggcagacctgagtgagctggtgaagaaaaaagaactctgcttcatccaccactggcgagacagatgccatcagaaaacccatcaccttttatcagaaccagggggccgtgccaaagatgcggcactgggaggaggacaccatcaggctggagctcagggaggagatgaaggtgaagctgctggagctgcagcagatggtattgcggcttacagcaactacaacaatgggcacagaaaattcctggccgctgcccacaactctgctgatgagcccggtccaggagccccagccccccaggagcttggggctgcagacaagcatggtgatctttgtgaggtgagcctcacctcctctgcccaaggagaggccagggaggatcctctccttgacaagcctactgcacagccgatcgtgcaggaccaccaggagcacccaggcttgggcagcaactgctgtgtgccattgttgtgctgggcttggctgccaagaagaaggagataa

SEQ ID NO: 138498 - DNA, 1899 bp, Homo sapiens
  Payload ID: 7131
  Gene Symbol: GOLGA8J
  Gene Name: golgin A8 family, member J
  Uniprot ID: A6NMD2
  ENST ID: ENST00000567927
  CDS Start-End: 1-1899
atggcagaagaaactcaacacaacaaattggctgcagccaagaaaaagttaaaagaatattggcagaaaaacagccctagagttccagcaggagcgaacaggaacaggaaaacaaatggcagtatccctgagaaagccacttctggtggttgccagccacctagggattcagcaacaggtttccacagggaaggccctacatcatctgctaccctgaaagatctggagagcccgtgccaagaacgagcagtagtcctggattcaaggtccgtagaaatcagtcaactgaagaacaccatcaaatctctgaaacaacagaagaaacaagtggaacatcagctggaagaagaaaagaaagcaaacaacaagaaacagaaagccaaaagggtgctagaggttcaaatccagacattgaacatacagaaagaggaactaaatacggacctgtaccacatgaaacgttctctcagatactttgaagaaaagtccaaggatctggctgtccgcctgcaacattcattgcagcgtaaaggagagttagagagtgttctctctaatgtcatggccacacagaagaagaaggcaaaccagttgtccagccgcagcaaagcacgtacggagtggaagttagagcagtccatgcgggaggaggcactactgaaagtgcagctgacacagttcaaggagtcatttcaacaagtccaattagaaagagatgagtattctgaacatctaaaaggagagagggcccggtggcagcagaggatgagaaaaatgtcgcaggagatttgcacattaaagaaagagaagcagcaagatatgcgtcgggtagagaagctggagaggagcttgtccaaactcaaaaaccagatggctgaacccttgcccccggagcccccagcagtgccctctgaggtggagctgcagcacctgaggaaggaactagagagagtggcaggagagctccaggcccaggtcaaaaacaatcagcgcataagtctcctgaaccagcgacaagaagagaggattcgggagcaggaagagaggcttcggaagcaggaggagaggattcaggagcagcacaagagccttcagcagctggccaagccacagagcgtcttcaaggagccgaacaatgagaacaagaacgcactgcagttggagcagcaagtaaaggagctacaggagaagcttggcgaggagcacctggaagctgccagccagcagaaccagcagctaacggcccagctgagcctcatggctctccctggggaaggacacggaggagaacatctggacagtgagggggaggaggcacctcggcccatgccgagtgtcccagaggacccggagagcagggaggccatgagcagctttatggaccacctggaggagaaggcagacctgagtgagctggtgaagaaaaaagaactctgcttcatccaccactggcgagagagatgccatcagaaaacccatcaccttttatcagaaccagggggccgtgccaaagatgcggcactgggaggaggacaccatcaggctggagctcagggaggagatgaaggtgaagctgctggagctgcagcagatggtattgcggcttacagcaactacaacaatgggcacagaaaattcctggccgctgcccacaactctgctgatgagcccggtccaggagccccagccccccaggagcttggggctgcagacaagcatggtcatctttgtgaggtgagcctcacctcctctgcccaaggagaggccagggaggatcctctccttgacaagcctactgcacagccgatcgtgcaggaccaccaggagcacccaggcttgggcagcaactgctgtgtgccattcttgtgctgggcttggctgccaagaagaaggagataa

SEQ ID NO: 138499 - DNA, 5199 bp, Homo sapiens
  Payload ID: 7131
  Gene Symbol: GOLGA8J
  Gene Name: golgin A8 family, member J
  Uniprot ID: A6NMD2
  ENST ID: ENST00000611771
  CDS Start-End: 99-1997
agtcacacagctgcctggtaggtgactggaggccttgatcggttctcattgagattttgctgctgtgaccccaaccctgcctccctccccaccctgcgatggcagaagaaactcaacacaacaaattggctgcagccaagaaaaagttaaaagaatattggcagaaaaacagccctagagttccagcaggagcgaacaggaacaggaaaacaaatggcagtatccctgagaaagccacttctggtggttgccagccacctagggattcagcaacaggtttccacagggaaggccctacatcatctgctaccctgaaagatctggagagcccgtgccaagaacgagcagtagtcctggattcaaggtccgtagaaatcagtcaactgaagaacaccatcaaatctctgaaacaacagaagaaacaagtggaacatcagctggaagaagaaaagaaagcaaacaacaagaaacagaaagccaaaagggtgctagaggttcaaatccagacattgaacatacagaaagaggaactaaatacggacctgtaccacatgaaacgttctctcagatactttgaagaaaagtccaaggatctggctgtccgcctgcaacattcattgcagcgtaaaggagagttagagagtgttctctctaatgtcatggccacacagaagaagaaggcaaaccagttgtccagccgcagcaaagcacgtacggagtggaagttagagcagtccatgcgggaggaggcactactgaaagtgcagctgacacagttcaaggagtcatttcaacaagtccaattagaaagagatgagtattctgaacatctaaaaggagagagggcccggtggcagcagaggatgagaaaaatgtcgcaggagatttgcacattaaagaaagagaagcagcaagatatgcgtcgggtagagaagctggagaggagcttgtccaaactcaaaaaccagatggctgaacccttgcccccggagcccccagcagtgccctctgaggtggagctgcagcacctgaggaaggaactagagagagtggcaggagagctccaggcccaggtcaaaaacaatcagcgcataagtctcctgaaccagcgacaagaagagaggattcgggagcaggaagagaggcttcggaagcaggaggagaggattcaggagcagcacaagagccttcagcagctggccaagccacagagcgtcttcaaggagccgaacaatgagaacaagaacgcactgcagttggagcagcaagtaaaggagctacaggagaagcttggcgaggagcacctggaagctgccagccagcagaaccagcagctaacggcccagctgagcctcatggctctccctggggaaggacacggaggagaacatctggacagtgagggggaggaggcacctcggcccatgccgagtgtcccagaggacccggagagcagggaggccatgagcagctttatggaccacctggaggagaaggcagacctgagtgagctggtgaagaaaaaagaactctgcttcatccaccactggcgagagagatgccatcagaaaacccatcaccttttatcagaaccagggggccgtgccaaagatgcggcactgggaggaggacaccatcaggctggagctcagggaggagatgaaggtgaagctgctggagctgcagcagatggtattgcggcttacagcaactacaacaatgggcacagaaaattcctggccgctgcccacaactctgctgatgagcccggtccaggagccccagccccccaggagcttggggctgcagacaagcatggtcatctttgtgaggtgagcctcacctcctctgcccaaggagaggccagggaggatcctctccttgacaagcctactgcacagccgatcgtgcaggaccaccaggagcacccaggcttgggcagcaactgctgtgtgccattcttgtgctgggcttggctgccaagaagaaggagataaacatcaccatcctcaaagagctgctcaagaaatttttaaataagaaaccaagttatggggttaatctcctacacaattcatttacttcctttgaatgttagagtcactcatgattatttgtttttctaatttatagttttaagtttatttgtaaaaagttaaaagagagtgggtgtctgtggctctcactgatgttcactctggcatcctttagcatttttcttttttaatttcataattgtaggtcattagcgtgcatatcgagtttgcccttacgtggtgggagttcaaacacacaaagacccactctttgcccaaaactgttctctttggtttggaataggctgccatgcttttttaatgttattgcagcatgtatattcactacagaattcagacaaaatttgcctatgttctgctgttgtttgatctaatcttaatcacagtgagctcttcattagctcaatatgtagtttgcccccaagtgtgcactgtttattactttgtaatatgccactatgagtactgacatttagagttgtttaaaggccaagaactggaaacagcctttcctccattttctgtgtgttggtgatgggagtgataaccttttgggggagctttttaaatctcacagaagaggaaagtggcctcctctggcaggtacgtgcaggatagagtgtgtttcatctgttccggtgcccggaattagcagtgtattatggtggttcccttaggatttgtatgtgctctgggctcatgaagatactgcatcatgagctgcagcagttgtactctttttcgatgacctaaaaagggcttatttctgaggaatgaaaggttcccatcattgactgtggatgtgggaaacctttcctagcttagagcatttgtatctacaatacattttaaagtcagagttcatgttacctgttttaatcacatgactacatgtcccagtacacaaaagggcactggttggcattcttcttaatgtatttagtgaagatcataagaaatcctttatgagttcaaacgttcctggaacaggcatacaggctctagtcaagaatgaattagagtgaaggaaagctgtgtgacacctggcattcctctctgttcacggagattctttgaggcttgaagattgattttaccatctagacctctttggctaatacctattcttcaaccaccttggttactctgacataggaatttacttctttttctttgaatggaaaacactttaaaaaataatagaaacattattataaactaatatatgtgagatacttagttgaaacaaaaaggagttttagtagacggtattgtactctctttgaaaatcaaggagaagtttatgaaacttaaaatgtgtacaaactgcagtgcaatctactgttcgtgaatgtcaatgtattatcaggaaacgtgtctatacaatcacagagttatattttctcacagacttctttacaaagtgaaatatgtttttgtacctctgggtttctgttcgggacatattttgtgcaatatttatgtgattgtgcctatgcatgatgaatgaatacatttcagttatatattgcctaaatcataacttgatgatgcttgggaaagactcaacagttaaaacttcatgaagttctaatgtctgtgttccaaaacacatcacattgttaggatgcagggagataggtgtgtgtgctccctgcggtggggatttctagttactagatcatctccatttttagcatttggcatcctcatgatacttctataaatatgacattaacaggagagcaacaatacgattttaccgatggaataacagatttgctggcattcactgaaagagtgcaaatattcggtccttgtgacttccactgactcttccaaattttatgaatgtatcaatgtattagataaacccagtttcagaatgataaagaaaaaatttagaccaaataatgcagctaattaacagtggtacgatttgtagcccgtgggtttaaaatgcacttaaagtcctgttctcgccttttattttctgaacttgccgcttttgcattctttgagttcagtttaaagacagttactttaagagcattttaaaccctcgggctagaaatcggaccactgttaatcagccacattatttggtctaacgttttttcttttatcattctgaaactgggtttatctaatacattgataaattattgcaaaggtacttttatcgttgaaatcacttcacttttaccctgataaatatcagtgactaggaatgaccttcggatagcgtttagcatctgtaaccaatctgacaataatgtgttcatgaggtgcctatggattaaatcacacactggcatatttaagctgaaggtcagtctggaaaataaatttactatattgactgaaataccactctttgtgtaggtatttgtcatatatttaagaaaaagttaaaaagaatggaaattgtatgacaataactcaagtctttctccaaagtgcatgcagtcttttgcgatacctcattcagccgagtatttgtgctcttcctcattcagtataaggcagctttcagtttgcttagaaggcaacattggaatgttagagttcatcagaaacatagaattttaaactgtgagttccactgaatacattttaatgtctgtaggaagaatcaaaacacctatttaaagatggcaatatataataatcattttaaaagtatttgattcaacctgataattttccagaaatgaaaaaaaaaaatcagctcttaaaccaaagctgattttagaaaatttgaaaatgtaaatcagccctatccataatatagtttctctaaaactttattttaaagagtcattttaaaataatataactattaaaaaatgtaactgctatcttaatgttctgaaataatttaaaacattttaaaatatgaatactgtagtataaaagaaagaaatggtgggaacgaaaagcagagaaagaaatgccaattccagtccaaagttttatttgccaagttttcttagaatgaattttaccagtttatgaattattgtaaagagaatgtgtcgtggaaatactgaaagatttttccctagagtggccttattgactgctggtgtgatgccactgtaatgtaataaattattaagttgtttcaatgtgttgtttt

SEQ ID NO: 138500 - DNA, 1894 bp, Homo sapiens
  Payload ID: 7132
  Gene Symbol: GOLGA8K
  Gene Name: golgin A8 family, member K
  Uniprot ID: D6RF30
  ENST ID: ENST00000512626
  CDS Start-End: 2-1894
gatggcagaagaaactcaacacaacaaattggctgcagccaagaaaaagttaaaagaatattggcagaaaaacagccctagagttccagcaggagcgaacaggaacaggaaaacaaatggcagtatccctgagaaagccacttctggtggttgccagccacctagggattcagcaacaggtttccacagggaaggccctacatcatctgctaccctgaaagatctggagagcccgtgccaagaacgagcagtagtcctggattcaaggtccgtagaaatcagtcaactgaagaacaccatcaaatctctgaaacaacagaagaaacaagtggaacatcagctggaagaagaaaagaaagcaaacaacaagaaacagaaagccaaaagggtgctagaggttcaaatccagacattgaacatacagaaagaggaactaaatacggacctgtaccacatgaaacgttctctcagatactttgaagaaaagtccaaggatctggctgtccgcctgcaacattcattgcagcgtaaaggagagttagagagtgttctctctaatgtcatggccacacagaagaagaaggcaaaccagttgtccagccgcagcaaagcacgtacggagtggaagttagagcagtccatgcgggaggaggcactactgaaagtgcagctgacacagttgaaggagtcttttcaacaagtccaattagaaagagatgagtattctgaacatctaaaaggagagagggcccggtggcagcagaggatgagaaaaatgtcgcaggagatttgcacattaaagaaagagaagcagcaagatatgcgtcgggtagagaagctggagaggagcttgtccaaactcaaaaaccagatggctgaacccttgcccccggagcccccagcagtgccctctgaggtggagctgcagcacctgaggaaggaactagagagagtggcaggagagctccaggcccaggtcaaaaagaatcagcgcataagtctcctgaaccagcgacaagaagagaggattcaggagcaggaagagaggcttcggaagcaggaggagaggattcaggagcagcacaagagccttcagcagctggccaagccacagagcgtcttcgaggagccgaacaatgagaacaagaacgcactgcagttggagcagcaagtaaaggagctacaggagaagcttggcgaggagcacctggaagcggccagccagcagaaccagcagctaacggcccagctgagcctcatggctctccctggggaaggacacggagaacatctggacagtgagggggaggaggcacctcagcccatgccgagtgtcccagaggacctggagagcagggaggccatgagcagctttatggaccacctgaaggagaaggcagacctgagtgagctggtgaaaaaagaactctgcttcatccaccactggcgagacagacgccatcagaaaacccatcaccttttatcagaaccagggggctgtgccaaagatgcggcactgggaggaggacaccatcaggctggagctcagggaggagatgaaggtgaagctgctggagctgcagcagatggtattgcggcttacagcaactacaacaatgggcacagaaaattcctggccgctgcccacaaccctgctgatgagcccggtccaggagccccagctccccaggagcttggggctgcagacaagcatggtgatcttcgtgaggtgagcctcacctcctctgcccaaggagaggccagggaggatcctctccttgacaagcctactgcacagccgatcgtgcaggaccacaaggagcacccaggcttgggcagcaactgctgtgtgccattattttgttgggcttggctgccaagaagaaggagataa

SEQ ID NO: 138501 - DNA, 1899 bp, Homo sapiens
  Payload ID: 7133
  Gene Symbol: GOLGA8M
  Gene Name: golgin A8 family, member M
  Uniprot ID: H3BSY2
  ENST ID: ENST00000563027
  CDS Start-End: 1-1899
atggcagaagaaactcaacacaacaaattggctgcagccaagaaaaagttaaaagaatattggcagaaaaacagccctagagttccagcaggagcgaacaggaacaggaaaacaaatggcagtatccctcagacagccacttctggtggttgccagccacctggggattcagcaacaggttttcacagggaaggccctacatcatctgctaccctgaaagatctggagagcccgtgccaagaacgagcagtagtcctggattcaaggtccgtagaaatcagtcaactgaagaacaccatcaaatctttgaaacaacagaagaaacaagtggaacatcagctggaagaagaaaagaaagcaaacaacaagaaacagaaagccaaaagggtgctagaggttcaactccagacattgaacatacagaaagaggaactaaatacggacctgtaccacatgaaacgttctctcagatactttgaagaaaagtccaaggatctggctgtccgcctgcaacattcattgcagcgtaaaggagagttagagagtgttctctctgatgtcatggccacacagaagaagaaggcaaaccagttgtccagccccagtaaagcaggtacggagtggaagttagagcagtccatgcgggaggaggcactactgaaagtgcagctgacacagttgaaggagtcatttcaacaagtccaattagaaagagatgagtattctgaacatctaaaaggagagagggcccggtggcagcagaggatgagaaaaatgtcgcaggagatttgcacattaaagaaagagaagcagcaagatatgcgtcgggtagagaagctggagaggagcttgtccaaactcaaaaaccagatggctgaacccttgcccccggagcccccagcagtgccctctgaggtggagctgcagcacctgaggaaggaactagagagagtggcaggagagctccaggcccaggtcaaaaacaatcagcgcataagtctcctgaaccagcgacaagaagagaggattcgggagcaggaagagaggcttcggaagcaggaggagaggattcaggagcagcacaagagccttcagcagctggccaagccacagagcgtcttcgaggagccgaacaatgagaacaagagcacactgcagttggagcagcaagtaaaggagctacaggagaagcttggcgaggagcacctggaagctgccagccagcagaaccagcagctaacggcccagctgagcctcatggctctccctggggaaggacacggaggagaacatctggacagtgagggggaggaggcacctcagcccatgccgagtgtcccagaggacccggagagcagggaggccatgagcagctttatggaccacctggaggagaaggcagacctgagtgagcttgtgaagaaacaagaacttcgcttcattcaatactggcaagagagatgccatcagaaaatccatcaccttttatcagaaccagggggccgtgccaaagatgcggcactgggaggaggacaccatcaggctggagctcagggaggagatgaaggtgaagctgctggagctgcagcagatggtattgcggcttacagcaactacaacaatgggcacagaaaattcctggccgctgcccacaactctgctgatgagcccggtccaggagccccagctccccaggagcttggggctgcagacaagcatggtgatctttgtgaggtgagcctcacctcctctgcccaaggagaggccagggaggatcctctccttgacaagcctactgcacagccgatcgtgcaggaccaccaggagcacccaggcttgggcagcaactgctgtgtgccattcttttgctgggcttggctgccaagaagaaggagataa

SEQ ID NO: 138502 - DNA, 5329 bp, Homo sapiens
  Payload ID: 7134
  Gene Symbol: GOLGA8N
  Gene Name: golgin A8 family, member N
  Uniprot ID: F8WBI6
  ENST ID: ENST00000448387
  CDS Start-End: 99-1997
agtcacacagctgcctggtaggtgactggaggccttgatcggttcttattgggattttgctgctgtggccccaacccttcctccctccccaccctgcgatggcagaagaaactcaacacaacaaattggctgcagccaagaaaaagttaaaagaatattggcagaaaaacagacctagagttccagcaggagtgaacaggaacaggaaaacaaatggcagtatccctgagacagccacttccggtggttgccagccacctggggattcagcaacaggtttccacagggaaggccctacatcatctgctaccctgaaagatctggagagcccgtgccaagaacgagcagtagtcctggattcaacgtccgtaaaaatcagtcgactgaagaacaccatcaaatctttgaaacaacagaagaaacaagtggaacatcagctggaagaagaaaagaaagcaaacaacgagagacagaaagccgaaagggagctagaggttcaaatccagacattgatcatacagaaagaggaactaaatacggacctgtaccacatggaacgttctctcagatactttgaagaagagtccaaggacctggctgtccgtctgcaacattcattgcagtgtaaaggagagttagagagcgctctgtctgctgtcatcgccacagagaagaagaaggcaaaccagttgtccagctgcagcaaagcacatacagagtgggagttagagcagtccctacaggaccaggcactgctgaaagcgcagctgacacagttgaaggagtcatttcaacaactccaattagaaagagatgagtgtgctgaacatatagaaggagagagggcccggtggcatcagaggatgagtaaaatgtcgcaggagatttgcacattaaagaaagagaagcagcaagatatgcgtcgggtagaggagctggagaggagcttgtccaaactcaaaaaccagatggctgaacccttgcccccggagcccccagcagtgccctctgaggtggagctgcagcacctgaggaaggaactagagagagtggcaggagagctccagtcccaggtcaaaaacaatcagcacataagtctcctgaaccggcgacaagaagagaggattcgggaacaggaagagaggcttcggaagcaggaggagaggcttcaggagcagcacgagaagcttcggcagctggccaagccacagagcgtcttcgaggagctgaacaatgagaacaagagcacactgcagttggagcagcaagtaaaggagctacaggagaagcttggcgaggagcacctggaagcggccagccagcagaaccagcagctaacggcccagctgagcctcatggctctccctggggaaggacacggaggagaacatctggacagtgagggggaggaggcacctcagcccatgccgagtgtcccagaggacctggagagcagggaggccatgagcagctttatggaccacctgaaggagaaggcagacctgagtgagctggtgaaaaaacaagaacttcgcttcattcaatactggcaagagagatgccatcagaaaatccatcaccttttatcagaaccagggggccgtgccaaagatgcagcactgggaggaggacaccatcaggctggagctcagggaggagatgaaggtgaagctgctggagctgcagcagatggtattgcggcttacagcaactacaacaatgggcacagaaaattcctggccgctgcccacaactctgctgatgagcccggtccaggagccccagccccccaggagcttggggctgcagacaagcatggtgatcttcgtgaggtgaccctcacctcctctgcccaaggagaggccagggaggatcctctccttgacaagcctactgcacagccgatcgtgcaggaccaccaggagcacccaggcttgggcagcaactgctgtgtgccattattttgttgggcttggctgccaagaagaaggagataaacatcaccatcatcaaacagctgctcaagaaatttttaaataagaaaccaagttatggggttaatctcctacacaattcatttacttcctttgaatgttagactcactcatgattatttgtgtttctaatttatagtttaagtttatttgtaaaaagttaaaagagagtgtgtgtctgtggctctcactgatgttcactctggcatcctttagcatttttcttttttaatttcataattgtaggtcattagcatgcatatcgagtttgcccttacgtggtgggagttcaaacacacaaagacccactctttgcccaaaactgttctctttggtttggaataggctgccatgcttttttaatgttattgcagcatgtatattcactacagcattcagacaaaatttgcctatgttctgctgttgtttgatctaatcttaatcacagtgagctcttccttagctcaatatgtagtttgcccccaagtgtgcactgtttattactttgtaatacgccactatgagtactgacatttagagttgtttaaaggccaagaattggaaacagcctttcctccattttctgtgtattggtgatgggagtgataaccttttgggggagctttttaaatctcacagaagaggaaagtggcctcctctggcaggtatgtgcaggatagagtgtgtttcatctcttccggtgccaggaattagcggtgtattatggtggtgcccttaggatttgtatgtgctctgggctcatgaagatattgcatcatgagctgcagcagttgcactctttttcgatgacctaaaaagggcttatttctgaggaatgaaaggttcccatcgttgactgtggatgtggaaaacctttcctagcttagagcatttgtatctacaatacattttaaagtcagagttcatgttacctgttttaatcacatgactacatgccccagtacacaaaagggcactggttggcattcttcttaatgtatttagtgaagatcataagaaatcctttacgagttcaaatgtccctggaacaggcatacaggctctagtcaagaatgaattagagtgaaggaaagctgtgtgactcctggcattcctctctgttcacggagattctttgaggcttgaagattgattttaccatctagacctctttggctaatacctattcttcaaccaccttggttactctgatataggaatttacttctttttctttgaatggaaaacactttaaaaaaaatagaaacattcttataaactaatatatgtgagatagttgaaacaaaaaggagttttagtagatggtattatactatctttgaaaatcaaggagaagtttatgaaacttaaaatgtgtacaaactgcagtgcaatctactgttgttcgtgaatgtcaatgtattatcaggaaacgtgtctatacaaccacagagttatattttctcacaaacttctttacaaagtgaaatatgtttttgtacctctgggtttctgttcgggacatattttgtgcgatatttatgtgattgtgcctatgcatgatgaatgaatgcatttcagttatgtattgcctaaatcgtaacttgatgatgcttgggaaagactcaacagttaaaacttcatgaagttctaatgtctgtgttccaaaacacatcacattgttaggatgcagggagataggtgtgtgtgctccctgcggtggggatttctagttactagatcatctccatttttagcatttggcatcctcatgatacttctataaatatgacattaacaggagagcaacaatacgattttaccgatggaataacagatttgctggcattcactgaaagagtgcaaatattcggtccttgtgacttccactgactcttccaaattttatgaatgtatcaatgtattagataaacccagtttcagaatgataaagaaaaaatcttagaccaaataatgcggctaattaacagtggtacgatttctagcccgtgggtttaaaatgcacttaaagtcctgttctcgccttttattttctgaacttgccgcttttgcattctttgagttcagtttaaagacagttactttaagagcattttaaaccctcgggctagaaatcggaccactgttaatcagccacattatttggtctaacgttttttcttttatcattctgaaactgggtttatctaatacattgataaattatttcaaaggtacttttatcgttgaaatcacttcacttttaccctgataaatatcagtgactaggaatgaccttcggatagcgtttagcatctgtaaccaatctgacaataatgtgttcatgaggtgcctatggattaaatcacacactggcatatttaagctgaaggtcagtctggaaaataaatttactatattgactgaaataccactctttgtgtaggtatttgtcatatatttaagaaaacactaaaaagaatggaaattgtatgacaataacttaagtctttctccaaagtgcatgcagtcttttgcgatacctcattcagccgagtatttgtactcttcctcattcagtataaggaagctttcagtttgcttagaaggcaacattggaatgttagagttcatgagaaacatagaattttaaactgtgagttccactgaatacattttaatgtctgtaggaagaatcaaaacacctatttaaagatggcaatatataataatcattttaaaagtatttgattcaacctaattttccagaaatgaaaaaaaaaaaatcagctctaaaaccaaagctgatttcagaaaatttgaaaatgtaaatcagccctatccataatatagtttctctaaaactttatcttagtcattttaaaataatataactattaaaaaatgtaactgctatcttaatgttctgaaataatttaaaacattttaaaatatgaatactgtagtataaaagaaagaaatggtgggaacgaaaagcagagaaagaaatgccaattccagtccaaagttttatttgccaagttttcttagaatgaattttaccagtttatgaattattgtaaacagaatgtgtcatggaaatactgaaagatttttccctagagtggccttattgactgctggtgtgatgccactgtaatgtaataaattattaaattgtttcaatgtgttgtttttgccttaaaattttattttgcgtttcttgaaaactatagtattaaaggtattgatactgtgcaaatgctgggcatgcttggcatgagataatgtgtttcatttttacaaaggtgtaatataactatgcaagtgtttct

SEQ ID NO: 138503 - DNA, 1791 bp, Homo sapiens
  Payload ID: 7134
  Gene Symbol: GOLGA8N
  Gene Name: golgin A8 family, member N
  ENST ID: ENST00000569659
  CDS Start-End: 1-1791
atggcagaagaaactcaacacaacaaattggctgcagccaagaaaaagttaaaagaatattggcagaaaaacagacctagagttccagcaggagtgaacaggaacaggaaaacaaatggcagtatccctgagacagccacttccggtggttgccagccacctggggattcagcaacaggtttccacagggaaggccctacatcatctgctaccctgaaagatctggagagcccgtgccaagaacgagcagtagtcctggattcaacgtccgtaaaaatcagtcgactgaagaacaccatcaaatctttgaaacaacagaagaaacaagtggaacatcagctggaagaagaaaagaaagcaaacaacgagagacagaaagccgaaagggagctagaggttcaaatccagacattgatcatacagaaagaggaactaaatacggacctgtaccacatggaacgttctctcagatactttgaagaagagtccaaggacctggctgtccgtctgcaacattcattgcagtgtaaaggagagttagagagcgctctgtctgctgtcatcgccacagagaagaagaaggcaaaccagttgtccagctgcagcaaagcacatacagagtgggagttagagcagtccctacaggaccaggcactgctgaaagcgcagctgacacagatttgcacattaaagaaagagaagcagcaagatatgcgtcgggtagaggagctggagaggagcttgtccaaactcaaaaaccagatggctgaacccttgcccccggagcccccagcagtgccctctgaggtggagctgcagcacctgaggaaggaactagagagagtggcaggagagctccagtcccaggtcaaaaacaatcagcacataagtctcctgaaccggcgacaagaagagaggattcgggaacaggaagagaggcttcggaagcaggaggagaggcttcaggagcagcacgagaagcttcggcagctggccaagccacagagcgtcttcgaggagctgaacaatgagaacaagagcacactgcagttggagcagcaagtaaaggagctacaggagaagcttggcgaggagcacctggaagcggccagccagcagaaccagcagctaacggcccagctgagcctcatggctctccctggggaaggacacggaggagaacatctggacagtgagggggaggaggcacctcagcccatgccgagtgtcccagaggacctggagagcagggaggccatgagcagctttatggaccacctgaaggagaaggcagacctgagtgagctggtgaaaaaacaagaacttcgcttcattcaatactggcaagagagatgccatcagaaaatccatcaccttttatcagaaccagggggccgtgccaaagatgcagcactgggaggaggacaccatcaggctggagctcagggaggagatgaaggtgaagctgctggagctgcagcagatggtattgcggcttacagcaactacaacaatgggcacagaaaattcctggccgctgcccacaactctgctgatgagcccggtccaggagccccagccccccaggagcttggggctgcagacaagcatggtgatcttcgtgaggtgaccctcacctcctctgcccaaggagaggccagggaggatcctctccttgacaagcctactgcacagccgatcgtgcaggaccaccaggagcacccaggcttgggcagcaactgctgtgtgccattattttgttgggcttggctgccaagaagaaggagataa

SEQ ID NO: 138504 - DNA, 555 bp, Homo sapiens
  Payload ID: 7134
  Gene Symbol: GOLGA8N
  Gene Name: golgin A8 family, member N
  ENST ID: ENST00000611209
  CDS Start-End: 161-555
gttactgcaagactggcctttgaccttacgacccagtcccctaagcgttctcaccccgtttctggttcctctggtcacagcacaaatttccagctggaaggggaatggagactatgggacctaggagcaagaggttccaggctgcctcactcccttacagatgttgacgttaaaagaatattggcagaaaaacagacctagagttccagcaggagtgaacaggaacaggaaaacaaatggcagtatccctgagacagccacttccggtggttgccagccacctggggattcagcaacaggtttccacagggaaggccctacatcatctgctaccctgaaagatctggagagcccgtgccaagaacgagcagtagtcctggattcaacgtccgtaaaaatcagtcgactgaagaacaccatcaaatctttgaaacaacagaagaaacaagtggaacatcagctggaagaagaaaagaaagcaaacaacgagagacagaaagccgaaagggagctagaggttcaaatccagacattgatcatacagaaagaggaact

SEQ ID NO: 138505 - DNA, 1997 bp, Homo sapiens
  Payload ID: 7135
  Gene Symbol: GOLGA8O
  Gene Name: golgin A8 family, member O
  Uniprot ID: A6NCC3
  ENST ID: ENST00000509311
  CDS Start-End: 99-1997
agtcacacagctgcctggtaggtgactggaggccttgatcggttcttattgggattttgctgctgtggccccaacccttcctccctccccaccctgcaatggcagaagaaactcaacacaacaaattggctgcagccaagaaaaagttaaaagaatattggcagaaaaacagacctagagttccagcaggagtgaacaggaacaggaaaacaaatggcagtatccctgagacagccacttccggtggttgccagccacctggggattcagcaacaggtttccacagggaaggccctacatcatctgctaccctgaaagatctggagagcccgtgccaagaacgagcagtagtcctggattcaacgtccgtaaaaatcagtcgactgaagaacaccatcaaatctttgaaacaacagaagaaacaagtggaacatcagctggaagaagaaaagaaagcaaacaacgagagacagaaagccgaaagggagctagaggttcaaatccagacattgatcatacagaaagaggaactaaatacggacctgtaccacatggaacgttctctcagatactttgaagaagagtccaaggacctggctgtccgcctgcaacattcattgcagtgtaaaggagagttagagagcgctctgtctgctgtcatcgccacagagaagaagaaggcaaaccagttgtccagctgcagcaaagcacatacagagtgggagttagagcagtccctacaggaccaggcactgctgaaagcgcagctgacacagttgaaggagtcatttcaacaactccaattagaaagagatgagtgtgctgaacatatagaaggagagagggcccggtggcatcagaggatgagtaaaatgtcgcaggagatttgcacattaaagaaagagaagcagcaagatatgcgtcgggtagaggagctggagaggagcttgtccaaactcaaaaaccagatggctgaacccttgcccccggagcccccagcagtgccctctgaggtggagctgcagcacctgaggaaggaactagagagagtggcaggagagctccagtcccaggtcaaaaacaatcagcacataagtctcctgaaccggcgacaagaagagaggattcgggaacaggaagagaggcttcggaagcaggaggagaggcttcaggagcagcacgagaagcttcggcagctggccaagccacagagcgtcttcgaggagctgaacaatgagaacaagagcacactgcagttggagcagcaagtaaaggagctacaggagaagcttggcgaggagcacctggaagcggccagccagcagaaccagcagctaacggcccagctgagcctcatggctctccctggggaaggacacggaggagaacatctggacagtgagggggaggaggcacctcggcccatgccgagtgtcccagaggacccggagagcagggaggccatgagcagctttatggaccacctgaaggagaaggcagacctgagtgagctggtgaaaaaacaagaacttcgcttcattcaatactggcaagagagatgccatcagaaaatccatcaccttttatcagaaccagggggccgtgccaaagatgcagcactgggaggaggacaccatcaggctggagctcagggaggagatgaaggtgaagctgctggagctgcagcagatggtattgcggcttacagcaactacaacaatgggcacagaaaattcctggccgctgcccacaactctgctgatgagcccggtccaggagccccagccccccaggagcttggggctgcagacaagcatggtgatcttcgtgaggtgaccctcacctcctctgcccaaggagaggccagggaggatcctctccttgacaagcctactgcacagccgatcgtgcaggaccaccaggagcacccaggcttgggcagcaactgctgtgtgccattattttgttgggcttggctgccaagaagaaggagataa

SEQ ID NO: 138506 - DNA, 555 bp, Homo sapiens; identical to SEQ ID NO: 138504
  Payload ID: 7135
  Gene Symbol: GOLGA8O
  Gene Name: golgin A8 family, member O
  ENST ID: ENST00000562377
  CDS Start-End: 161-555

SEQ ID NO: 138507 - DNA, 1899 bp, Homo sapiens
  Payload ID: 7136
  Gene Symbol: GOLGA8Q
  Gene Name: golgin A8 family, member Q
  ENST ID: ENST00000562783
  CDS Start-End: 1-1899
atggcagaagaaactcaacacaacaaattggctgcagccaagaaaaagttaaaagaatattggcagaaaaacagacctagagttccagcaggagtgaacagaaacaggaaaacaaatggcagtatccctgagacagccacttccggtggttgccagccacctggggattcagcaacaggtttccacagggaaggccctacatcatctgctaccctgaaagatctggagagcccgtgccaagaacgagcagtagtcctggattcaacgtccgtaaaaatcagtcgactgaagaacaccatcaaatctttgaaacaacagaagaaacaagtggaacatcagctggaagaagaaaagaaagcaaacaacgagagacagaaagccgaaagggagctagaggttcaaatccagacattgatcatacagaaagaggaactaaatacggacctgtaccacatggaacgttctctcagatactttgaagaagagtccaaggacctggctgtccgcctgcaacattcattgcagtgtaaaggagagttagagagggctctgtctgctgtcatcgccacagagaagaagaaggcaaaccagttgtccagctgcagcaaagcacatacagagtgggagttagagcagtccctacaggaccaggcactgctgaaagcgcagctgacacagttgaaggagtcatttcaacaactccaattagaaagagatgagtgtgctgaacatatagaaggagagagggcccggtggcatcagaggatgagtaaaatgttgcaggagatttgcacattaaagaaagagaagcagcaagatatgcgtcgggtagaggagctggagaggagcttgtccaaactcaaaaaccagatggctgaacccttgcccccggagcccccagcagtgccctctgaggtggagctgcagcacctgaggaaggaactagagagagtggcaggagagctccagtcccaggtcaaaaacaatcagcacataagtctcctgaaccggcgacaagaagagaggattcgggaacaggaagagaggcttcggaagcaggaggagaggcttcaggagcagcacgagaagcttcggcagctggccaagccacagagcgtcttcgaggagctgaacaatgagaacaagagcacactgcagttggagcagcaagtaaaggagctacaggagaagcttggcgaggagcacctggaagcggccagccagcagaaccagcagctaacggcccagctgaacctcatggctctccctggggaaggacacggaggagaacatctggacagtgagggggaggaggcacctcagcccatgccgagtgtcccagaggacctggagagcagggaggccatgagcagctttatggaccacctgaaggagaaggcagacctgagtgagctggtgaaaaaacaagaacttcgcttcattcaatactggcaagagagatgccatcagaaaatccatcaccttttatcagaaccagggggccgtgccaaagatgcagcactgggaggaggacaccatcaggctggagctcagggaggagatgaaggtgaagctgctggagctgcagcagatggtattgcggcttacagcaactacaacaatgggcacagaaaattcctggccgctgcccacaactctgctgatgagcccggtccaggagccccagccccccaggagcttggggctgcagacaagcatggtgatcttcgtgaggtgaccctcacctcctctgcccaaggagaggccagggaggatcctctccttgacaagcctactgcacagccgatcgtgcaggaccaccaggagcacccaggcttgggcagcaactgctgtgtgccattattttgttgggcttggctgccaagaagaaggagataa

SEQ ID NO: 138508 - DNA, 1896 bp, Homo sapiens
  Payload ID: 7137
  Gene Symbol: GOLGA8R
  Gene Name: golgin A8 family, member R
  Uniprot ID: I6L899
  ENST ID: ENST00000327271
  CDS Start-End: 1-1896
atggcagaagaaactcaacacaacaaattggctgcagccaagaaaaagttaaaagaatattggcagaaaaacagacctagagttccagcaggagtgaacaggaacaggaaaacaaatggcagtatccctgagacagccacttccggtggttgccagccacctggggattcagcaacaggtttccacagggaaggccctacatcatctgctaccctgaaagatctggagagcccgtgccaagaacgagcagtagtcctggattcaacgtccgtaaaaatcagtcgactgaagaacaccatcaaatctttgaaacaacagaagaaacaagtggaacatcagctggaagaagaaaagaaagcaaacaacgagagacagaaagccgaaagggtgctagaggttcaaatccagacattgatcatacagaaagaggaactaaatacggacctgtaccacatggaacgttctctcagatactttgaagaagagtccaaggacctggctgtccgcctgcaacattcattgcagtgtaaaggagagttagagagggctctgtctgctgtcatcgccacagagaagaagaaggcaaaccagttgtccagctgcagcaaagcacatacagagtgggagttagagcagtccctacaggaccaggcactgctgaaagcgcagctgacacagttgaaggagtcatttcaacaactccaattagaaagagatgagtgtgctgaacatatagaaggagagagggcccggtggcatcagaggatgagtaaaatgtcgcaggagatttgcacattaaagaaagagaagcaggatatgcgttgggtagagcagctggagtggagcttgtccaaactcaaaaaccagacggctgaacccttgcccccggagcccccagcagtgccctctgaggtggagctgcagcacctgaggaaggaactagagagagtggcaggagagctccagtcccaggtcaaaaacaatcagcacataagtctcctgaaccggcgacaagaagagaggattcgggaacaggaagagaggcttcggaagcaggaggagaggcttcaggagcagcacgagaagcttcggcagctggccaagccacagagcgtcttcgaggagctgaacaatgagaacaagagcacactgcagttggagcagcaagtaaaggagctacaggagaagcttggcgaggagcacctggaagtggccagccagcagaaccagcagctaacggcccagctgagcctcatggctctccctggggaaggacacggaggagaacatctggacagtgagggggaggaggcacctcagcccatgccgagtgtcccagaggacccggagagcagggaggccatgagcagctttatggaccacctgaaggagaaggcagacctgagtgagctgctgaaaaaacaagaacttcgcttcattcaatactggcaagagagatgccatcagaaaatccatcaccttttatcagaaccagggggccgtgccaaagatgcagcactgggaggaggacaccatcaggctggagctcagggaggagatgaaggtgaagctgctggagctgcagcagatggtattgcggcttacagcaactacaacaatgggcacagaaaattcctggccgctgcccacaactctgctgatgagcccggtccaggagccccagccccccaggagcttggggctgcagacaagcatggtgatcttcgtgaggtgaccctcacctcctctgcccaaggagaggccagggaggatcctctccttgacaagcctactgcacagccgatcgtgcaggaccaccaggagcacccaggcttgggcagcaactgctgtgtgccattattttgttgggcttggctgccaagaagaaggagataa

SEQ ID NO: 138509 - DNA, 1878 bp, Homo sapiens
  Payload ID: 7138
  Gene Symbol: GOLGA8S
  Gene Name: golgin A8 family, member S
  ENST ID: ENST00000562295
  CDS Start-End: 1-1878
atggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgaggtccgtaaaagtcagtcaactgaagaacaccatcaaatctttgaaacaacagaagaaacaagtggtacatcagctggaagaagaaaagaaagcaaacaacgagaaacagaaagccgaaagggagctagaggttcaaatccagagattgaacatacagaaagggaaactaaatacggacctgtaccacacgaaacgttctctcagatactttgaagaagagtccaaggatctggccgtccgtctgcaacattcattgcagcgtaaaggagagttagagcgggctctctctgctgtcaccgccacacagaagaagaaggcggagaggttctccagccgcagtaaagcacgtacggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagacgctggagaggagcttgtccaaactcaaaaaccagatggctgaacctctgcccccggagcccccagcagtgccctctgaggcggagctgcagcacctgaggaaggaactagagagagtggcaggagcgctccaggcccaggtggagtacaatcagcgcataagtctcctgaatgaggggcaaaaggagaggcttcgggagcagcaggagaggcttccagagcaggaggagaggcttcagcagctggccgagccacagaacagcttcaaggagctgaacaatgagaacaagagcgtactacagttggagcagcaagtaaaggagctgcaggagaagctaggcaaggagcgtctggaagctgccagccagcagaaacagcagctaacggcccagttgagcctcatggctctccctggggaaggagatggaggaggacatctggacagtgagggggaggaggcacctcggcccattcctagcatcccacaggacctggagagcagggaggccatgagcagctttatggaccacctggaggagaaggcagacctgagtgagctggtgaagaaacaagaacttcgcttcattcaatactggcaagagagatgccatcagaaaatccatcaccttttatcagaaccagggggccgtgccaaagatgcggcactgggaggaggacaccatcaggctggagctcagggaggagatgaagatgaagctgctggagctgcagcagatggtattgcggcttacagcaactacaacaatgggcacagaaaattcctggccgctgcccacaaccctgctgatgagcccggtccaggagccccagccccccaggagcttggggctgcagacaagcatggtgatctttgtgaggtgagcctcacctcctctgcccaaggagaggccagggaggatcctctccttgacaagcctactgcacagccgatcgtgcaggaccaccaggagcacccaggcttgggcaacaactgctgtgtgccattcttttgctgggcttggctgccaagaagaaggagataa

SEQ ID NO: 138510 - DNA, 1896 bp, Homo sapiens
  Payload ID: 7139
  Gene Symbol: GOLGA8T
  Gene Name: golgin A8 family, member T
  ENST ID: ENST00000569052
  CDS Start-End: 1-1896
atggcagaagaaactcaacacaacaaattggctgcagccaagaaaaagttaaaagaatattggcagaaaaacagccctagagttccagcaggagcgaacaggaacaggaaaacaaatggcagtatccctgagaaagccacttctggtggttgccagccacctagggattcagcaacaggtttccacagggaaggccctacatcatctgctaccctgaaagatctggagagcccgtgccaagaacgagcagtagtcctggattcaaggtccgtagaaatcagtcaactgaagaacaccatcaaatctctgaaacaacagaagaaacaagtggaacatcagctggaagaagaaaagaaagcaaacaacaagaaacagaaagccaaaagggtgctagaggttcaaatccagacattgaacatacagaaagaggaactaaatacggacctgtaccacatgaaacgttctctcagatactttgaagaaaagtccaaggatctggctgtccgcctgcaacattcattgcagcgtaaaggagagttagagagtgttctctctaatgtcatggccacacagaagaagaaggcaaaccagttgtccagccgcagcaaagcacgtacggagtggaagttagagcagtccatgcgggaggagacactactgaaagtgcagctgacacagttgaaggagtcatttcaacaagtccaattagaaagagatgagtattctgaacatctaaaaggagagagggcccggtggcagcagaggatgagaaaaatgtcgcaggagatttgcacattaaagaaagagaagcagcaagatatgcgtcgggtagaggagctggagaggagcttgtccaaactcaaaaaccagatggctgaacccttgcccccggagcccccagcagtgccctctgaggtggagctgcagcacctgaggaaggaactagagagagtggcaggagagctccaggcccaggtcaaaaagaatcagcgcataagtctcctgaaccagcgacaagaagagaggattcaggagcaggaagagaggcttcggaagcaggaggagaggattcaggagcagcacaagagccttcagcagctggccaagccacagagcgtcttcgaggagccgaacaatgagaacaagaacgcactgcagttggagcagcaagtaaaggagctacaggagaagcttggcgaggagcacctggaagctgccagccagcagaaccagcagctaacggcccagctgagcctcatggctctccctggggaaggacacggaggagaacatctggacagtgagggggaggaggcacctcagcccatgccgagtgtcccagaggacctggagagcagggaggccatgagcagctttatggaccacctgaaggagaaggcagacctgagtgagctggtgaaaaaagaactctgcttcatccaccactggcgagacagacgccatcagaaaacccatcaccttttatcagaaccagggggctgtgccaaagatgcggcactgggaggaggacaccatcaggctggagctcagggaggagatgaaggtgaagctgctggagctgcagcagatggtattgcggcttacagcaactacaacaatgggcacagaaaattcctggccgctgcccacaaccctgctgatgagcccggtccaggagccccagctccccaggagcttggggctgcagacaagcatggtgatcttcgtgaggtgagcctcacctcctctgcccaaggagaggccagggaggatcctctccttgacaagcctactgcacagccgatcgtgcaggaccaccaggagcacccaggcttgggcagcaactgctgtgtgccattcttgtgctgggcttggctgccaagaagaaggagataa

SEQ ID NO: 138511 - DNA, 11187 bp, Homo sapiens
  Payload ID: 7140
  Gene Symbol: GOLGB1
  Gene Name: golgin B1
  Uniprot ID: Q14789
  ENST ID: ENST00000340645
  CDS Start-End: 127-9906
aactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgagcaagcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaaggtaatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcagtatcattttgattgataactttctttgccttgtttgcctgtattttctcctgtttcagggggaaggtggctctgccataaacagagttcagggaaatgaacatgtcacctcataggacatctgatttaggtctcttgcagaatagggtggtgaaagctgaaggaactccctaggggttttagctgttagatcacatgggaggacagcatcttcttccctgccaatttcagatataattggagggagaatttcaggtcttagactataaggatagaatccctttgcttttgcccttgatcacatgtatactaaggtattaagtggcccaagtctttcctttcaccaaagggcagggagaagtgtctatggacagcagggttccaattcttgtcattccaggaatatctgaatattcctggaatgtggaccctgagacagtgctcaggggccactgggagccaatattaggcattgactctcagccaggagtctgactggtctaacaccacactgcaactcctgacctcttgaagtactaagctactttgctgttagtgacagttattacagtttctcagccccattgtctctgccctctgtggcaatggaaggagaatatagagaagacaaaattaaatatagatagacctgagaaggacagccaggatagaattccatttgtgcctattccctgcctcccctcccctcccccatcctaccagttggttattttctcattgcatacgtgatgtgttcactgcctagcctctccctaaagaagagagaagacaagtgggctgactgatctgctctaaatctactgtggtgattaaatcttggttacaacatcctgggaagtttcctgaacaactgtaaaataataaaattattttcagaatgaaga

SEQ ID NO: 138512 - DNA, 11198 bp, Homo sapiens
  Payload ID: 7140
  Gene Symbol: GOLGB1
  Gene Name: golgin B1
  Uniprot ID: Q14789
  ENST ID: ENST00000393667
  CDS Start-End: 112-9921
agtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagttgagttccatgcagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgagcaagcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaaggtaatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggtgagtaaagagaaggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcagtatcattttgattgataactttctttgccttgtttgcctgtattttctcctgtttcagggggaaggtggctctgccataaacagagttcagggaaatgaacatgtcacctcataggacatctgatttaggtctcttgcagaatagggtggtgaaagctgaaggaactccctaggggttttagctgttagatcacatgggaggacagcatcttcttccctgccaatttcagatataattggagggagaatttcaggtcttagactataaggatagaatccctttgcttttgcccttgatcacatgtatactaaggtattaagtggcccaagtctttcctttcaccaaagggcagggagaagtgtctatggacagcagggttccaattcttgtcattccaggaatatctgaatattcctggaatgtggaccctgagacagtgctcaggggccactgggagccaatattaggcattgactctcagccaggagtctgactggtctaacaccacactgcaactcctgacctcttgaagtactaagctactttgctgttagtgacagttattacagtttctcagccccattgtctctgccctctgtggcaatggaaggagaatatagagaagacaaaattaaatatagatagacctgagaaggacagccaggatagaattccatttgtgcctattccctgcctcccctcccctcccccatcctaccagttggttattttctcattgcatacgtgatgtgttcactgcctagcctctccctaaagaagagagaagacaagtgggctgactgatctgctctaaatctactgtggtgattaaatcttggttacaacatcctgggaagtttcctgaacaactgtaaaataataaaattattttcagaatg

SEQ ID NO: 138513 - DNA, 280 bp, Homo sapiens
  Payload ID: 7140
  Gene Symbol: GOLGB1
  Gene Name: golgin B1
  ENST ID: ENST00000472475
  CDS Start-End: 157-280
ggtctttagggcggagatcacagaatcattggagatattaatgcaaacggaggcctgtccaataatcctgctaatgctaatgggttactggaaagatgagaagagaggaaagatcccaacgatcccgtcaacacgaaaatcccaggaatcagagaaatgctgagccgattatcaggattagcaaatgttgttttgcatgaattatcaggagatgatgacactgatcagaatatgagggctcccctagaccctgaattacaccaagaatctgacatggaat

SEQ ID NO: 138514 - DNA, 3093 bp, Homo sapiens
  Payload ID: 7140
  Gene Symbol: GOLGB1
  Gene Name: golgin B1
  ENST ID: ENST00000489400
  CDS Start-End: 1-3093
cttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgagcaagcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccag

SEQ ID NO: 138515 - DNA, 4959 bp, Homo sapiens
  Payload ID: 7140
  Gene Symbol: GOLGB1
  Gene Name: golgin B1
  ENST ID: ENST00000494517
  CDS Start-End: 38-4959
ggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgagcaagcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaa

SEQ ID NO: 138516 - DNA, 10295 bp, Homo sapiens
  Payload ID: 7140
  Gene Symbol: GOLGB1
  Gene Name: golgin B1
  ENST ID: ENST00000482512
  CDS Start-End: 94-213
gcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgtgagtagttctgttctgatttaaactggaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagttgagttccatgcagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgagcaagcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaaggtaatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcagta

SEQ ID NO: 138517 - DNA, 901 bp, Homo sapiens
  Payload ID: 7140
  Gene Symbol: GOLGB1
  Gene Name: golgin B1
  ENST ID: ENST00000491690
  CDS Start-End: 1-330
gcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcgtggagacagggtttcaccatcttggccaggctggtcttgaactcctgatcttgtgatccacccacctcggcctcccaaagtgctgggattacaggcttgagccacggcgcccggcccagacttaacttttaagaggagaaattcaagaatgagaatctgggagaaaaatctaatcaagacaagagttttatgtaggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctact

SEQ ID NO: 138518 - DNA, 11115 bp, Homo sapiens
  Payload ID: 7140
  Gene Symbol: GOLGB1
  Gene Name: golgin B1
  Uniprot ID: Q14789
  ENST ID: ENST00000614479
  CDS Start-End: 284-9838
atcttccgtcccaactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgtgagtagttctgttctgatttaaactggaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgagcaagcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaaggtaatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcagtatcattttgattgataactttctttgccttgtttgcctgtattttctcctgtttcagggggaaggtggctctgccataaacagagttcagggaaatgaacatgtcacctcataggacatctgatttaggtctcttgcagaatagggtggtgaaagctgaaggaactccctaggggttttagctgttagatcacatgggaggacagcatcttcttccctgccaatttcagatataattggagggagaatttcaggtcttagactataaggatagaatccctttgcttttgcccttgatcacatgtatactaaggtattaagtggcccaagtctttcctttcaccaaagggcagggagaagtgtctatggacagcagggttccaattcttgtcattccaggaatatctgaatattcctggaatgtggaccctgagacagtgctcaggggccactgggagccaatattaggcattgactctcagccaggagtctgactggtctaacaccacactgcaactcctgacctcttgaagtactaagctactttgctgttagtgacagttattacagtttctcagccccattgtctctgccctctgtggcaatggaaggagaatatagagaagacaaaattaaatatagatagacctgagaaggacagccaggatagaattccatttgtgcctattccctgcctcccctcccctcccccatcctaccagttggttattttctcattgcatacgtgatgtgttcactgcctagcctctccctaaagaagagagaagacaagtgggctgactgatctgctctaaatctactgtggtgattaaatcttggttacaacatcctgggaagtttcctgaacaactgtaaaataataaaattattttcagaatg

SEQ ID NO: 138519 - DNA, 1699 bp, Homo sapiens
  Payload ID: 7141
  Gene Symbol: GORAB
  Gene Name: golgin, RAB6-interacting
  Uniprot ID: Q5T7V8
  ENST ID: ENST00000367762
  CDS Start-End: 19-759
ggccggggaaaaacccggatgagctgggcagcagtgttggcagtcgcggctgcgagatttgggcacttttgggggtgccggtggcccgggccgatggcgcaaggttgggcaggattctctgaggaggaactgaggagactaaagcagactaaagatccatttgaaccacagcgacgtctccccgcgaagaaaagtcgacaacaacttcagcgagaaaaagcccttgtagagcaaagccaaaaacttgggcttcaagatggatcaacctcattacttccagagcagctgctttcagcaccaaaacagagagttaacgttcaaaaaccacctttttcttcccctactcttccgagtcatttcactctcacctcccccgttggtgatggacaaccacagggcattgaaagtcagccaaaggaactgggacttgagaattcccatgatggtcacaacaatgttgagattctacctccaaagccagattgcaaattggagaaaaagaaagtggaattgcaagaaaaatctcgttgggaagtcctccaacaagaacaacggctaatggaagagaaaaataaacgtaaaaaagctcttttggctaaagctattgcagaaagatccaaaagaactcaggcagagaccatgaaactaaagcggatccagaaggagttgcaggctttagatgacatggtgtcagctgacattggaattctcaggaaccggattgatcaggccagcttagactattcatacgctcggtgagttggggaaattgaatctgaacaaggagtatgatttaattaatgtttattgccagctgttccaggggcttttatgtatatcatcattgaagcctcaaaacaaccccattcagtgctgtatttattcttcttttgtgctaattcaagtgtctcctcttcagtgaagtcttccttaactctgccctactagttaaccttgttcgtgtgccattagagcagttcttgcattatttatttacgttttagtctttgctgcgaaaccctcagctatttaatgtttggaagtgtttttgctcatctttcagcatctagcaaagtaaatatctgagtggtttcgccaaaactgttactctgacaccaagtctgtgttctttccattaaaatttttgatatctgatatagtcctataggattgaagtctagtcctcactttagctttcatcagagtaagaggatctagtttagtttttaaaagcttatgaatattttaagcatatcctctgtcttggaaatttgaaatattttctctttttttttcctttcaattatactctgtatgaaatggtttaatatatgtttccttggtttcaaccattggcattttttaaaagagaaaaaataccatggagtatttttaaaatgaactaacacatgtaatgaattacatggactttgcagacagataaaagggcaaaaaaatatgtccaatttcagggttttcagccctttcaacattgctttaatcatcctggtttgtcttttttcacaagggaatgctgtgttaatgactcagttttctatcttactctgttacactagaaatgaatcagaatgcctcattaggccagggtaaaccacaacatcagaatgtttatataacaatttattaaagcggaaatgcttgattgtggtttttaataaactgttgagtgtttaagaaa

SEQ ID NO: 138520 - DNA, 2189 bp, Homo sapiens
  Payload ID: 7141
  Gene Symbol: GORAB
  Gene Name: golgin, RAB6-interacting
  Uniprot ID: Q5T7V8
  ENST ID: ENST00000367763
  CDS Start-End: 21-1205
gcggccggggaaaaacccggatgagctgggcagcagtgttggcagtcgcggctgcgagatttgggcacttttgggggtgccggtggcccgggccgatggcgcaaggttgggcaggattctctgaggaggaactgaggagactaaagcagactaaagatccatttgaaccacagcgacgtctccccgcgaagaaaagtcgacaacaacttcagcgagaaaaagcccttgtagagcaaagccaaaaacttgggcttcaagatggatcaacctcattacttccagagcagctgctttcagcaccaaaacagagagttaacgttcaaaaaccacctttttcttcccctactcttccgagtcatttcactctcacctcccccgttggtgatggacaaccacagggcattgaaagtcagccaaaggaactgggacttgagaattcccatgatggtcacaacaatgttgagattctacctccaaagccagattgcaaattggagaaaaagaaagtggaattgcaagaaaaatctcgttgggaagtcctccaacaagaacaacggctaatggaagagaaaaataaacgtaaaaaagctcttttggctaaagctattgcagaaagatccaaaagaactcaggcagagaccatgaaactaaagcggatccagaaggagttgcaggctttagatgacatggtgtcagctgacattggaattctcaggaaccggattgatcaggccagcttagactattcatacgctcggaagcggtttgacagggctgaagcagagtacattgcagcaaagctagatatacagcgcaagactgagataaaagagcaactcactgaacacctttgtacgatcatacagcaaaatgagctccgaaaggccaagaagttggaggagttgatgcaacaactagatgtagaagccgatgaagagactttggagcttgaggtggaggtcgagagattgctacacgaacaagaagtagaatcaaggagaccagtggttcgtttagagaggccatttcagcctgcggaggagagtgtgacattagaatttgctaaagagaacagaaagtgtcaagaacaagctgtttccccaaaggtagatgaccagtgtggaaattccagtagcatcccctttcttagtccaaactgcccaaatcaagaaggtaatgacatttcagctgctttggccacatgaagttctggtattcttttgagctaatatggtattgagtaaagtatactttttgcagtagatcatgccctgacctccaataaaaacctctttaaaacaatgctgatttttgaattcatgattagttttagtaaattaataggtttggccattctaaaatccaaaattatgataactgtatttctaggggtatgtttcaccttgattttggcccggttctttcagtgttccgtttaccctttttactgaaagtaagtgacttaaaaggatggaagaaaaactacatggttggagtgtttttagatcagataaatatagaaaagtaaaatggaaaatgatactcaatacctagttaaactcatttcacttctcctgggagacgtattaagactggaagtcctattttatttaatcagtatcagtaaaaagacaaaaattacagtgtgaacaagagaaaaacaggaatagaagaaaaaagttgcaggttgaattatctatctggatattactagagttgtaaaacacaacttggaaactggaatttatgtgaagaaccaaacaacttaaaccagcatcacttttgtcttcaatttgccttccagtgattttagtttacaacctgcgttttgttatttgaaacacacacacttatatataaacacatgtaattttactattttattgtctttcctttaatcgatgaattgattaaatttagacaattaaaacatttctaaagtgagactgaaaataatatagaaaatctcattgctacttgtgattatcaaaaaaagtatgtattttctttctaaagttatctataaatatgtttttgatatgttggacatgaattaccctgtcatgaagcgtttaaattgttaaaatgctgattttcttattagtttgttaattgcctgttactagtacttgaccaatacattgtgctatatgtaaatgtgtaaataaatattgtaattttctcacaaa

SEQ ID NO: 138521 - DNA, 2467 bp, Homo sapiens
  Payload ID: 7141
  Gene Symbol: GORAB
  Gene Name: golgin, RAB6-interacting
  ENST ID: ENST00000498166
  CDS Start-End: 1-379
gagctgggcagcagtgttggcagtcgcggctgcgagatttgggcacttttgggggtgccggtggcccgggccgatggcgcaaggttgggcaggattctctgaggaggaactgaggagactaaagcagactaaagggtacaagtgccctggcctctggtctgactccagtagactcatgaggagacaaaccacaaagttatgtgatagtagatattgcaagaacttgcttcagagacaagaggaacctcactctgccggggattggatggagcttgggaagatttcacaaagtttgtgtgttagcagaggcgcattttccaggacaaaagaaaagtcaacaaaagacatgaatagatatttcctagaaaaggaaatatgaagagatgctcatcaccaccaaggagcagagaattacaaatcaagaatacagtgagatccatttgaaccacagcgacgtctccccgcgaagaaaagtcgacaacaacttcagcgagaaaaagcccttgtagagcaaagccaaaaacttgggcttcaagatggatcaacctcattacttccagagcagctgctttcagcaccaaaacagagagttaacgttcaaaaaccacctttttcttcccctactcttccgagtcatttcactctcacctcccccgttggtgatggacaaccacagggcattgaaagtcagccaaaggaactgggacttgagaattcccatgatggtcacaacaatgttgagattctacctccaaagccagattgcaaattggagaaaaagaaagtggaattgcaagaaaaatctcgttgggaagtcctccaacaagaacaacggctaatggaagagaaaaataaacgtaaaaaagctcttttggctaaagctattgcagaaagatccaaaagaactcaggcagagaccatgaaactaaagcggatccagaaggagttgcaggctttagatgacatggtgtcagctgacattggaattctcaggaaccggattgatcaggccagcttagactattcatacgctcggaagcggtttgacagggctgaagcagagtacattgcagcaaagctagatatacagcgcaagactgagataaaagagcaactcactgaacacctttgtacgatcatacagcaaaatgagctccgaaaggccaagaagttggaggagttgatgcaacaactagatgtagaagccgatgaagagactttggagcttgaggtggaggtcgagagattgctacacgaacaagaagtagaatcaaggagaccagtggttcgtttagagaggccatttcagcctgcggaggagagtgtgacattagaatttgctaaagagaacagaaagtgtcaagaacaagctgtttccccaaaggtagatgaccagtgtggaaattccagtagcatcccctttcttagtccaaactgcccaaatcaagaaggtaatgacatttcagctgctttggccacatgaagttctggtattcttttgagctaatatggtattgagtaaagtatactttttgcagtagatcatgccctgacctccaataaaaacctctttaaaacaatgctgatttttgaattcatgattagttttagtaaattaataggtttggccattctaaaatccaaaattatgataactgtatttctaggggtatgtttcaccttgattttggcccggttctttcagtgttccgtttaccctttttactgaaagtaagtgacttaaaaggatggaagaaaaactacatggttggagtgtttttagatcagataaatatagaaaagtaaaatggaaaatgatactcaatacctagttaaactcatttcacttctcctgggagacgtattaagactggaagtcctattttatttaatcagtatcagtaaaaagacaaaaattacagtgtgaacaagagaaaaacaggaatagaagaaaaaagttgcaggttgaattatctatctggatattactagagttgtaaaacacaacttggaaactggaatttatgtgaagaaccaaacaacttaaaccagcatcacttttgtcttcaatttgccttccagtgattttagtttacaacctgcgttttgttatttgaaacacacacacttatatataaacacatgtaattttactattttattgtctttcctttaatcgatgaattgattaaatttagacaattaaaacatttctaaagtgagactgaaaataatatagaaaatctcattgctacttgtgattatcaaaaaaagtatgtattttctttctaaagttatctataaatatgtttttgatatgttggacatgaattaccctgtcatgaagcgtttaaattgttaaaatgctgattttcttattagtttgttaattgcctgttactagtacttgaccaatacattgtgctatatgtaaatgtgtaaataaatattgtaattttctcacaaa

SEQ ID NO: 138522 - DNA, 7138 bp, Homo sapiens
  Payload ID: 7142
  Gene Symbol: GON4L
  Gene Name: gon-4-like (C. elegans)
  Uniprot ID: Q3T8J9
  ENST ID: ENST00000271883
  CDS Start-End: 164-6886
tggcgcatagtgttaggcgcatgctccttgatgcactgcggcgcggcgctccgaggctcggggacgcgcacgcaattcgctgttgttggctgacttccggtggtgccaaagccgtttccgtggaatcaggccggctgaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgaaactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagcacgttcagctcttgacccaaatccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaatttgttagctttaggactgaagcattttgaaggaactgagtttcctaatcctctaatcagcaagtaccttctaacctgcaaaactgcccaccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcgaagcctagaaaaagacaatttggagttggggagtgaatctcggtacccactgctattgcctaagggtgtagtcctgaaactgaagccagttgccacccgtttccccaggaaggcttggagacagaagcgttcatcagtcctgaagcccctccttatccaacccagcccctctctccagcccagcttcaaccctgggaaaacaccagcccgatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctgtgccccctgaggccaggacaagcttccctctgtctgagtcccagactttgctctcttctgcccctgtgcccaaggtaatgctgccctcccttgccccttctaagtttcgaaagccatatgtgagacggagaccctcaaagagaagaggagtcaaggcctctccctgtatgaaacctgcccctgttatccaccaccctgcatctgttatcttcactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggaaacaatggagaaactgacttggctggcatctgaaaggcgcatgagtcaggagggtgagtctgaagaagagaattctcaggaggagaactctgagccagaagaagaggaggaagaagaagcagaaggaatggaaagcctgcagaaagaggatgaaatgacggatgaagcagttggagactctgctgagaagcctcctacttttgcttcacctgagactgctccagaagtggagaccagcagaactccaccaggagagagcatcaaagctgctggaaaaggccggaacaatcatcgagctcgcaacaagcggggaagtcgggctcgggccagcaaggacacctccaagctgctgttgctgtatgatgaggacattctcgagcgagatccactcagggagcagaaggacttggcctttgcccaagcttatctgaccagggtgcgagaagccctacaacatatccctggcaagtatgaagacttccttcaagtcatctatgaatttgagtcaagtacccagagacggacggctgtagatctctacaaaagcctgcaaattctgctccaagactggcctcagctgttgaaagactttgctgctttcctgttacctgagcaagctctggcctgtggattatttgaggagcagcaggcttttgagaagagccgcaagttccttcggcagctggagatttgctttgcagagaacccctcacaccaccagaagattatcaaggtcctccaaggctgtgcagactgccttccccaggagatcaccgagctcaagacacagatgtggcagctcctcaagggccacgaccacctgcaggatgagttttctatcttctttgaccacttgcgcccagcagctagccggatgggtgactttgaagagatcaattggactgaggaaaaggagtatgagtttgatggctttgaagaagtggccctgcctgatgtggaagaagaggaggagcctcccaagatacccacagcctcaaagaacaagaggaaaaaagagatcggggtccaaaatcatgataaggagactgaatggccagatggggccaaggactgtgcctgctcctgccatgaaggaggtccagattccaagctgaagaagagcaaaaggcggagctgtagccactgtagcagcaaggtctgtgacagcaaatcctacaagagcaaggagccccatgagttggtgggcagcagcccccaccgagaggctagtcctatgcctggtgctaaggaagctgggcagggcaaggatatgatggaagaggaagccccagaggagcgggagagcactgaggccacccagagcaggactgtcaggaccaccagaaagggagagatgcctgtttcaggattggcagtggggagcactttgccatcccctcgagaagtgactgttacagaacggctcctcctggatggcccaccacctcattcaccagagactcctcaatttccccccacaactggagctgtactgtacactgttaagagaaaccaggttgggcctgaggttcgctcctgccccaaggcatcccccagacttcagaaagagagggagggccaaaaggcagtgagtgagtcagaggctttgatgctggtctgggatgcatcagaaactgagaaattgcctggtaccgtggaaccccctgcttccttcctgagtcctgtttcctcaaagaccagagatgcagggagaagacatgtgtccgggaaaccagacactcaagagagatggctgccctcaagcagagctcgggtgaagacaagagacaggacgtgccctgtccatgaatctccatcaggaattgacacctcagagacttctcccaaagcccctagagggggtttggctaaagacagtggaacacaggccaagggtccagagggggagcagcagccaaaggccgcagaagctacggtgtgtgccaacaacagcaaggtcagctccactggggaaaaggttgtcctgtggacaagggaagctgaccgtgtgatcctcaccatgtgccaggagcaaggggcacagccacagaccttcaacatcatctcccagcagctgggaaataagacccctgctgaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcc

SEQ ID NO: 138523 - DNA, 5118 bp, Homo sapiens
  Payload ID: 7142
  Gene Symbol: GON4L
  Gene Name: gon-4-like (C. elegans)
  Uniprot ID: Q3T8J9
  ENST ID: ENST00000361040
  CDS Start-End: 73-4662
gacttccggtggtgccaaagccgtttccgtggaatcaggccggctgaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgaaactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagcacgttcagctcttgacccaaatccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaatttgttagctttaggactgaagcattttgaaggaactgagtttcctaatcctctaatcagcaagtaccttctaacctgcaaaactgcccaccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcgaagcctagaaaaagacaatttggagttggggagtgaatctcggtacccactgctattgcctaagggtgtagtcctgaaactgaagccagttgccacccgtttccccaggaaggcttggagacagaagcgttcatcagtcctgaagcccctccttatccaacccagcccctctctccagcccagcttcaaccctgggaaaacaccagcccgatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctgtgccccctgaggccaggacaagcttccctctgtctgagtcccagactttgctctcttctgcccctgtgcccaaggtaatgctgccctcccttgccccttctaagtttcgaaagccatatgtgagacggagaccctcaaagagaagaggagtcaaggcctctccctgtatgaaacctgcccctgttatccaccaccctgcatctgttatcttcactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggtgagagctggagaatattctcaagtatttcgtggactcagtaatatgtatcacttattgatatgccacctgcttgcttgctgcactatggatagtcctaaaatcatttgtatttgatttgtgaatgcattatgggacatgattgtggagttgaggtgaaatgagatggaaaggatgaaattttacttattatattaaactcgtttacacattaaattgaatcacctgaccatactttaaatgccttaaaaaatagtaataggctgggcttggtggctcactcctgtagtcccagcactttgggaggctgaggtgggtggatcacaaggccaggagtttcagactggcctggccgacgtggtaaaaccccatctatattaaaaataacaaaaattagccaggcatggtggcggacacctgtaatccctgctgcttgggaggcagaggcaggagaattgcttgagcccgagagacagaggttgcagtgagccgagatcacgtcattgctctccagcctgggcaacagagcaaggctctgtctcaaaaaaaaaaaaaaaaaaaaaaaaaaaaaaa

SEQ ID NO: 138524 - DNA, 7823 bp, Homo sapiens
  Payload ID: 7142
  Gene Symbol: GON4L
  Gene Name: gon-4-like (C. elegans)
  Uniprot ID: Q3T8J9
  ENST ID: ENST00000368331
  CDS Start-End: 176-6901
tggcgcatagtgttaggcgcatgctccttgatgcactgcggcgcggcgctccgaggctcggggacgcgcacgcaattcgctgttgttggctgacttccggtggtgccaaagccgtttccgtggaatcaggccggctggtgagggtacagaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgaaactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagcacgttcagctcttgacccaaatccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaatttgttagctttaggactgaagcattttgaaggaactgagtttcctaatcctctaatcagcaagtaccttctaacctgcaaaactgcccaccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcgaagcctagaaaaagacaatttggagttggggagtgaatctcggtacccactgctattgcctaagggtgtagtcctgaaactgaagccagttgccacccgtttccccaggaaggcttggagacagaagcgttcatcagtcctgaagcccctccttatccaacccagcccctctctccagcccagcttcaaccctgggaaaacaccagcccgatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctgtgccccctgaggccaggacaagcttccctctgtctgagtcccagactttgctctcttctgcccctgtgcccaaggtaatgctgccctcccttgccccttctaagtttcgaaagccatatgtgagacggagaccctcaaagagaagaggagtcaaggcctctccctgtatgaaacctgcccctgttatccaccaccctgcatctgttatcttcactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggaaacaatggagaaactgacttggctggcatctgaaaggcgcatgagtcaggagggtgagtctgaagaagagaattctcaggaggagaactctgagccagaagaagaggaggaagaagaagcagaaggaatggaaagcctgcagaaagaggatgaaatgacggatgaagcagttggagactctgctgagaagcctcctacttttgcttcacctgagactgctccagaagtggagaccagcagaactccaccaggagagagcatcaaagctgctggaaaaggccggaacaatcatcgagctcgcaacaagcggggaagtcgggctcgggccagcaaggacacctccaagctgctgttgctgtatgatgaggacattctcgagcgagatccactcagggagcagaaggacttggcctttgcccaagcttatctgaccagggtgcgagaagccctacaacatatccctggcaagtatgaagacttccttcaagtcatctatgaatttgagtcaagtacccagagacggacggctgtagatctctacaaaagcctgcaaattctgctccaagactggcctcagctgttgaaagactttgctgctttcctgttacctgagcaagctctggcctgtggattatttgaggagcagcaggcttttgagaagagccgcaagttccttcggcagctggagatttgctttgcagagaacccctcacaccaccagaagattatcaaggtcctccaaggctgtgcagactgccttccccaggagatcaccgagctcaagacacagatgtggcagctcctcaagggccacgaccacctgcaggatgagttttctatcttctttgaccacttgcgcccagcagctagccggatgggtgactttgaagagatcaattggactgaggaaaaggagtatgagtttgatggctttgaagaagtggccctgcctgatgtggaagaagaggaggagcctcccaagatacccacagcctcaaagaacaagaggaaaaaagagatcggggtccaaaatcatgataaggagactgaatggccagatggggccaaggactgtgcctgctcctgccatgaaggaggtccagattccaagctgaagaagagcaaaaggcggagctgtagccactgtagcagcaaggtctgtgacagcaaatcctacaagagcaaggagccccatgagttggtgggcagcagcccccaccgagaggctagtcctatgcctggtgctaaggaagctgggcagggcaaggatatgatggaagaggaagccccagaggagcgggagagcactgaggccacccagagcaggactgtcaggaccaccagaaagggagagatgcctgtttcagcaggattggcagtggggagcactttgccatcccctcgagaagtgactgttacagaacggctcctcctggatggcccaccacctcattcaccagagactcctcaatttccccccacaactggagctgtactgtacactgttaagagaaaccaggttgggcctgaggttcgctcctgccccaaggcatcccccagacttcagaaagagagggagggccaaaaggcagtgagtgagtcagaggctttgatgctggtctgggatgcatcagaaactgagaaattgcctggtaccgtggaaccccctgcttccttcctgagtcctgtttcctcaaagaccagagatgcagggagaagacatgtgtccgggaaaccagacactcaagagagatggctgccctcaagcagagctcgggtgaagacaagagacaggacgtgccctgtccatgaatctccatcaggaattgacacctcagagacttctcccaaagcccctagagggggtttggctaaagacagtggaacacaggccaagggtccagagggggagcagcagccaaaggccgcagaagctacggtgtgtgccaacaacagcaaggtcagctccactggggaaaaggttgtcctgtggacaagggaagctgaccgtgtgatcctcaccatgtgccaggagcaaggggcacagccacagaccttcaacatcatctcccagcagctgggaaataagacccctgctgaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcctttctctacttttttttggtctgatggcacatatttattgttctgtggtctaatcacagtgtttctaaatgtaaaaagtgcatatgttggtgtagctagtcccgcgacattgagctcctctgcatgaagacactgggctcctgcatccagctgtttttattgcaaactagctcctttctcccacactgggaactttagtccacgaggctgtcaccaccctggtagcactgggccaggctttgtagctcctgcagcagctctgctacgtcatcgtgctccactccagcatccatgaagctggcccagcgccgcaagtcgagtttggtgaggtctctggccaaggcttccagggtctggtgcagggacgaagaggaacacagtgccccaaacactgggatgctctccactgctgtggagggagaggaaacagagacctgtagatggatgattattctgccctgggactcgccaaactgataaggaagtccaaccttagtagacttgattgtaaactcaacaaatttggtgtattgtccccttagtacaccagtactccagaggaagaatgcttttcttgggagccatagggtgaataaaggaatgtttaactgtggactttttcagcacttttaatccaggaatggagatagtaaaacctctcccatacttg

SEQ ID NO: 138525 - DNA, 7713 bp, Homo sapiens
  Payload ID: 7142
  Gene Symbol: GON4L
  Gene Name: gon-4-like (C. elegans)
  Uniprot ID: Q3T8J9
  ENST ID: ENST00000437809
  CDS Start-End: 124-6846
ctctcccggaggggactcctcccaccgccgagttttcccgagaatgaggccgcgcccactgacgcgctgtggttccaaaacgagaaagtactgaaggaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgaaactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagcacgttcagctcttgacccaaatccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaatttgttagctttaggactgaagcattttgaaggaactgagtttcctaatcctctaatcagcaagtaccttctaacctgcaaaactgcccaccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcgaagcctagaaaaagacaatttggagttggggagtgaatctcggtacccactgctattgcctaagggtgtagtcctgaaactgaagccagttgccacccgtttccccaggaaggcttggagacagaagcgttcatcagtcctgaagcccctccttatccaacccagcccctctctccagcccagcttcaaccctgggaaaacaccagcccgatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctgtgccccctgaggccaggacaagcttccctctgtctgagtcccagactttgctctcttctgcccctgtgcccaaggtaatgctgccctcccttgccccttctaagtttcgaaagccatatgtgagacggagaccctcaaagagaagaggagtcaaggcctctccctgtatgaaacctgcccctgttatccaccaccctgcatctgttatcttcactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggaaacaatggagaaactgacttggctggcatctgaaaggcgcatgagtcaggagggtgagtctgaagaagagaattctcaggaggagaactctgagccagaagaagaggaggaagaagaagcagaaggaatggaaagcctgcagaaagaggatgaaatgacggatgaagcagttggagactctgctgagaagcctcctacttttgcttcacctgagactgctccagaagtggagaccagcagaactccaccaggagagagcatcaaagctgctggaaaaggccggaacaatcatcgagctcgcaacaagcggggaagtcgggctcgggccagcaaggacacctccaagctgctgttgctgtatgatgaggacattctcgagcgagatccactcagggagcagaaggacttggcctttgcccaagcttatctgaccagggtgcgagaagccctacaacatatccctggcaagtatgaagacttccttcaagtcatctatgaatttgagtcaagtacccagagacggacggctgtagatctctacaaaagcctgcaaattctgctccaagactggcctcagctgttgaaagactttgctgctttcctgttacctgagcaagctctggcctgtggattatttgaggagcagcaggcttttgagaagagccgcaagttccttcggcagctggagatttgctttgcagagaacccctcacaccaccagaagattatcaaggtcctccaaggctgtgcagactgccttccccaggagatcaccgagctcaagacacagatgtggcagctcctcaagggccacgaccacctgcaggatgagttttctatcttctttgaccacttgcgcccagcagctagccggatgggtgactttgaagagatcaattggactgaggaaaaggagtatgagtttgatggctttgaagaagtggccctgcctgatgtggaagaagaggaggagcctcccaagatacccacagcctcaaagaacaagaggaaaaaagagatcggggtccaaaatcatgataaggagactgaatggccagatggggccaaggactgtgcctgctcctgccatgaaggaggtccagattccaagctgaagaagagcaaaaggcggagctgtagccactgtagcagcaaggtctgtgacagcaaatcctacaagagcaaggagccccatgagttggtgggcagcagcccccaccgagaggctagtcctatgcctggtgctaaggaagctgggcagggcaaggatatgatggaagaggaagccccagaggagcgggagagcactgaggccacccagagcaggactgtcaggaccaccagaaagggagagatgcctgtttcaggattggcagtggggagcactttgccatcccctcgagaagtgactgttacagaacggctcctcctggatggcccaccacctcattcaccagagactcctcaatttccccccacaactggagctgtactgtacactgttaagagaaaccaggttgggcctgaggttcgctcctgccccaaggcatcccccagacttcagaaagagagggagggccaaaaggcagtgagtgagtcagaggctttgatgctggtctgggatgcatcagaaactgagaaattgcctggtaccgtggaaccccctgcttccttcctgagtcctgtttcctcaaagaccagagatgcagggagaagacatgtgtccgggaaaccagacactcaagagagatggctgccctcaagcagagctcgggtgaagacaagagacaggacgtgccctgtccatgaatctccatcaggaattgacacctcagagacttctcccaaagcccctagagggggtttggctaaagacagtggaacacaggccaagggtccagagggggagcagcagccaaaggccgcagaagctacggtgtgtgccaacaacagcaaggtcagctccactggggaaaaggttgtcctgtggacaagggaagctgaccgtgtgatcctcaccatgtgccaggagcaaggggcacagccacagaccttcaacatcatctcccagcagctgggaaataagacccctgctgaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcctttctctacttttttttggtctgatggcacatatttattgttctgtggtctaatcacagtgtttctaaatgtaaaaagtgcatatgttggtgtagctagtcccgcgacattgagctcctctgcatgaagacactgggctcctgcatccagctgtttttattgcaaactagctcctttctcccacactgggaactttagtccacgaggctgtcaccaccctggtagcactgggccaggctttgtagctcctgcagcagctctgctacgtcatcgtgctccactccagcatccatgaagctggcccagcgccgcaagtcgagtttggtgaggtctctggccaaggcttccagggtctggtgcagggacgaagaggaacacagtgccccaaacactgggatgctctccactgctgtggagggagaggaaacagagacctgtagatggatgattattctgccctgggactcgccaaactgataaggaagtccaaccttagtagacttgattgtaaactcaacaaatttggtgtattgtccccttagtacaccagtactccagaggaagaatgcttttcttgggagccatagggtgaataaaggaatgtttaactgtgga

SEQ ID NO: 138526 - DNA, 4801 bp, Homo sapiens
  Payload ID: 7142
  Gene Symbol: GON4L
  Gene Name: gon-4-like (C. elegans)
  ENST ID: ENST00000622608
  CDS Start-End: 176-4801
tggcgcatagtgttaggcgcatgctccttgatgcactgcggcgcggcgctccgaggctcggggacgcgcacgcaattcgctgttgttggctgacttccggtggtgccaaagccgtttccgtggaatcaggccggctggtgagggtacagaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgaaactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagcacgttcagctcttgacccaaatccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaatttgttagctttaggactgaagcattttgaaggaactgagtttcctaatcctctaatcagcaagtaccttctaacctgcaaaactgcccaccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcgaagcctagaaaaagacaatttggagttggggagtgaatctcggtacccactgctattgcctaagggtgtagtcctgaaactgaagccagttgccacccgtttccccaggaaggcttggagacagaagcgttcatcagtcctgaagcccctccttatccaacccagcccctctctccagcccagcttcaaccctgggaaaacaccagcccgatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctgtgccccctgaggccaggacaagcttccctctgtctgagtcccagactttgctctcttctgcccctgtgcccaaggtaatgctgccctcccttgccccttctaagtttcgaaagccatatgtgagacggagaccctcaaagagaagaggagtcaaggcctctccctgtatgaaacctgcccctgttatccaccaccctgcatctgttatcttcactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggtgagagctggagaatattctcaagtatttcgtggactcagtaatatgtatcacttattgatatgccacctgcttgcttgctgcactatggatagtcctaaaatcatttgtatttttgtgaatgcattatgggacatgattgtggagttgagg

SEQ ID NO: 138527 - DNA, 5506 bp, Homo sapiens
  Payload ID: 7142
  Gene Symbol: GON4L
  Gene Name: gon-4-like (C. elegans)
  ENST ID: ENST00000620426
  CDS Start-End: 164-3076
tggcgcatagtgttaggcgcatgctccttgatgcactgcggcgcggcgctccgaggctcggggacgcgcacgcaattcgctgttgttggctgacttccggtggtgccaaagccgtttccgtggaatcaggccggctgaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgaaactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagcacgttcagctcttgacccaaatccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaatttgttagctttaggactgaagcattttgaaggaactgagtttcctaatcctctaatcagcaagtaccttctaacctgcaaaactgcccaccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggaaacaatggagaaactgacttggctggcatctgaaaggcgcatgagtcaggagggtgagtctgaagaagagaattctcaggaggagaactctgagccagaagaagaggaggaagaagaagcagaaggaatggaaagcctgcagaaagaggatgaaatgacggatgaagcagttggagactctgctgagaagcctcctacttttgcttcacctgagactgctccagaagtggagaccagcagaactccaccaggagagagcatcaaagctgctggaaaaggccggaacaatcatcgagctcgcaacaagcggggaagtcgggctcgggccagcaaggacacctccaagctgctgttgctgtatgatgaggacattctcgagcgagatccactcagggagcagaaggacttggcctttgcccaagcttatctgaccagggtgcgagaagccctacaacatatccctggcaagtatgaagacttccttcaagtcatctatgaatttgagtcaagtacccagagacggacggctgtagatctctacaaaagcctgcaaattctgctccaagactggcctcagctgttgaaagactttgctgctttcctgttacctgagcaagctctggcctgtggattatttgaggagcagcaggcttttgagaagagccgcaagttccttcggcagctggagatttgctttgcagagaacccctcacaccaccagaagattatcaaggtcctccaaggctgtgcagactgccttccccaggagatcaccgagctcaagacacagatgtggcagctcctcaagggccacgaccacctgcaggatgagttttctatcttctttgaccacttgcgcccagcagctagccggatgggtgactttgaagagatcaattggactgaggaaaaggagtatgagtttgatggctttgaagaagtggccctgcctgatgtggaagaagaggaggagcctcccaagatacccacagcctcaaagaacaagaggaaaaaagagatcggggtccaaaatcatgataagattggcagtggggagcactttgccatcccctcgagaagtgactgttacagaacggctcctcctggatggcccaccacctcattcaccagagactcctcaatttccccccacaactggagctgtactgtacactgttaagagaaaccaggttgggcctgaggttcgctcctgccccaaggcatcccccagacttcagaaagagagggagggccaaaaggcagtgagtgagtcagaggctttgatgctggtctgggatgcatcagaaactgagaaattgcctggtaccgtggaaccccctgcttccttcctgagtcctgtttcctcaaagaccagagatgcagggagaagacatgtgtccgggaaaccagacactcaagagagatggctgccctcaagcagagctcgggtgaagacaagagacaggacgtgccctgtccatgaatctccatcaggaattgacacctcagagacttctcccaaagcccctagagggggtttggctaaagacagtggaacacaggccaagggtccagagggggagcagcagccaaaggccgcagaagctacggtgtgtgccaacaacagcaaggtcagctccactggggaaaaggttgtcctgtggacaagggaagctgaccgtgtgatcctcaccatgtgccaggagcaaggggcacagccacagaccttcaacatcatctcccagcagctgggaaataagacccctgctgaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcc

SEQ ID NO: 138528 - DNA, 7771 bp, Homo sapiens
  Payload ID: 7142
  Gene Symbol: GON4L
  Gene Name: gon-4-like (C. elegans)
  Uniprot ID: Q3T8J9
  ENST ID: ENST00000615926
  CDS Start-End: 124-6849
ctctcccggaggggactcctcccaccgccgagttttcccgagaatgaggccgcgcccactgacgcgctgtggttccaaaacgagaaagtactgaaggaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgaaactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagcacgttcagctcttgacccaaatccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaatttgttagctttaggactgaagcattttgaaggaactgagtttcctaatcctctaatcagcaagtaccttctaacctgcaaaactgcccaccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcgaagcctagaaaaagacaatttggagttggggagtgaatctcggtacccactgctattgcctaagggtgtagtcctgaaactgaagccagttgccacccgtttccccaggaaggcttggagacagaagcgttcatcagtcctgaagcccctccttatccaacccagcccctctctccagcccagcttcaaccctgggaaaacaccagcccgatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctgtgccccctgaggccaggacaagcttccctctgtctgagtcccagactttgctctcttctgcccctgtgcccaaggtaatgctgccctcccttgccccttctaagtttcgaaagccatatgtgagacggagaccctcaaagagaagaggagtcaaggcctctccctgtatgaaacctgcccctgttatccaccaccctgcatctgttatcttcactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggaaacaatggagaaactgacttggctggcatctgaaaggcgcatgagtcaggagggtgagtctgaagaagagaattctcaggaggagaactctgagccagaagaagaggaggaagaagaagcagaaggaatggaaagcctgcagaaagaggatgaaatgacggatgaagcagttggagactctgctgagaagcctcctacttttgcttcacctgagactgctccagaagtggagaccagcagaactccaccaggagagagcatcaaagctgctggaaaaggccggaacaatcatcgagctcgcaacaagcggggaagtcgggctcgggccagcaaggacacctccaagctgctgttgctgtatgatgaggacattctcgagcgagatccactcagggagcagaaggacttggcctttgcccaagcttatctgaccagggtgcgagaagccctacaacatatccctggcaagtatgaagacttccttcaagtcatctatgaatttgagtcaagtacccagagacggacggctgtagatctctacaaaagcctgcaaattctgctccaagactggcctcagctgttgaaagactttgctgctttcctgttacctgagcaagctctggcctgtggattatttgaggagcagcaggcttttgagaagagccgcaagttccttcggcagctggagatttgctttgcagagaacccctcacaccaccagaagattatcaaggtcctccaaggctgtgcagactgccttccccaggagatcaccgagctcaagacacagatgtggcagctcctcaagggccacgaccacctgcaggatgagttttctatcttctttgaccacttgcgcccagcagctagccggatgggtgactttgaagagatcaattggactgaggaaaaggagtatgagtttgatggctttgaagaagtggccctgcctgatgtggaagaagaggaggagcctcccaagatacccacagcctcaaagaacaagaggaaaaaagagatcggggtccaaaatcatgataaggagactgaatggccagatggggccaaggactgtgcctgctcctgccatgaaggaggtccagattccaagctgaagaagagcaaaaggcggagctgtagccactgtagcagcaaggtctgtgacagcaaatcctacaagagcaaggagccccatgagttggtgggcagcagcccccaccgagaggctagtcctatgcctggtgctaaggaagctgggcagggcaaggatatgatggaagaggaagccccagaggagcgggagagcactgaggccacccagagcaggactgtcaggaccaccagaaagggagagatgcctgtttcagcaggattggcagtggggagcactttgccatcccctcgagaagtgactgttacagaacggctcctcctggatggcccaccacctcattcaccagagactcctcaatttccccccacaactggagctgtactgtacactgttaagagaaaccaggttgggcctgaggttcgctcctgccccaaggcatcccccagacttcagaaagagagggagggccaaaaggcagtgagtgagtcagaggctttgatgctggtctgggatgcatcagaaactgagaaattgcctggtaccgtggaaccccctgcttccttcctgagtcctgtttcctcaaagaccagagatgcagggagaagacatgtgtccgggaaaccagacactcaagagagatggctgccctcaagcagagctcgggtgaagacaagagacaggacgtgccctgtccatgaatctccatcaggaattgacacctcagagacttctcccaaagcccctagagggggtttggctaaagacagtggaacacaggccaagggtccagagggggagcagcagccaaaggccgcagaagctacggtgtgtgccaacaacagcaaggtcagctccactggggaaaaggttgtcctgtggacaagggaagctgaccgtgtgatcctcaccatgtgccaggagcaaggggcacagccacagaccttcaacatcatctcccagcagctgggaaataagacccctgctgaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcctttctctacttttttttggtctgatggcacatatttattgttctgtggtctaatcacagtgtttctaaatgtaaaaagtgcatatgttggtgtagctagtcccgcgacattgagctcctctgcatgaagacactgggctcctgcatccagctgtttttattgcaaactagctcctttctcccacactgggaactttagtccacgaggctgtcaccaccctggtagcactgggccaggctttgtagctcctgcagcagctctgctacgtcatcgtgctccactccagcatccatgaagctggcccagcgccgcaagtcgagtttggtgaggtctctggccaaggcttccagggtctggtgcagggacgaagaggaacacagtgccccaaacactgggatgctctccactgctgtggagggagaggaaacagagacctgtagatggatgattattctgccctgggactcgccaaactgataaggaagtccaaccttagtagacttgattgtaaactcaacaaatttggtgtattgtccccttagtacaccagtactccagaggaagaatgcttttcttgggagccatagggtgaataaaggaatgtttaactgtggactttttcagcacttttaatccaggaatggagatagtaaaacctctcccatacttg

SEQ ID NO: 138529 - DNA, 1760 bp, Homo sapiens
  Payload ID: 7143
  Gene Symbol: GNRH1
  Gene Name: gonadotropin-releasing hormone 1 (luteinizing-releasing hormone)
  Uniprot ID: P01148
  ENST ID: ENST00000276414
  CDS Start-End: 1325-1603
gtcctatatttgttgtatagcctcctttgtggaagttatgtatgcatttgacttcacttaatctaagacatctattttccttgaactcttgataggtctgctggtttcctcaagggaatccaatctagctggattttaatctctttgaattgtgtcctcagctataaaagttttagctgaggttttaatggctgcacttaagtaaatctaacagatataccagggggtgttccaattacatacaccattaaagggctttatgtgaggatttttaaaaattaccattaaaaaaaaaaaagcatagtccatttgcagtataatttaccagcaggaaagatttcaatgtcctggaaaaattccctataaaaaggaagataggaaaacagaaaagtcacagtactcaacctacttcaagggaagattgggatctttttggctctctgcctctaaacaggtaaaaggctttgtattatttctagcacgagtttttcttctttagattgcatgctattgtatgtctacagggcatttgacagcccaagggctaaatccaggtgtgacggtatctaatgatgtcctgtccttcactgtccttgccatcaccagccacagagatccaggctttggggactcccacagcttatcgaccagtgtttgatttagtttttagcctctttcccatcaaatgaaaattaacttggagacacatttcattagaaaattagaggcccccttggctaggaaggcatctggtctgggactaactactttgaacagtgttgagtcctctctcccacagatggttcagccagcagtaatgctaggaagactgaaggataaatagaaaaatgtcattagtaccatggggtagccatgtaatgtcaagcaattttatattagccagagattcctagtaggagctacttttcttaacagatgactcagttctctttatctcaggaatgaaagagttgaagaccaatccacaacaggggaaatgttaaggcaaaatgatgaacttgataagggatgaattatggggtttggataaccaaacaataaaaataaaagtatagactattttagtactaaaaaggtcctgaacatgtgagcttaagtactcattttgtccccagtggctaagaaactaaaggcaagccagcaagtgtctctgagtttcagtgtctgtatgtaaaaactgactctgacttccatcttctgcagggttagtgatacagatgctagctttttcactaaagaggtcttttagtttatactcaaccttgtctggatctaatttgattgtgcattcatgtgccttagaatgaagccaattcaaaaactcctagctggccttattctactgacttggtgcgtggaaggctgctccagccagcactggtcctatggactgcgccctggaggaaagagagatgccgaaaatttgattgattctttccaagagatagtcaaagaggttggtcaactggcagaaacccaacgcttcgaatgcaccacgcaccagccacgttctcccctccgagacctgaaaggagctctggaaagtctgattgaagaggaaactgggcagaagaagatttaaatccattgggccagaaggaatgaccattactaacatgacttaagtataattctgacattgaaaatttataacccattaaatacctgtaaatggtatgaatttcagaaatccttacaccaagttgcacatattccataataaagtgctgtgttgtgaa

SEQ ID NO: 138530 - DNA, 470 bp, Homo sapiens
  Payload ID: 7143
  Gene Symbol: GNRH1
  Gene Name: gonadotropin-releasing hormone 1 (luteinizing-releasing hormone)
  Uniprot ID: P01148
  ENST ID: ENST00000421054
  CDS Start-End: 33-311
gggatctttttggctctctgcctctaaacagaatgaagccaattcaaaaactcctagctggccttattctactgacttggtgcgtggaaggctgctccagccagcactggtcctatggactgcgccctggaggaaagagagatgccgaaaatttgattgattctttccaagagatagtcaaagaggttggtcaactggcagaaacccaacgcttcgaatgcaccacgcaccagccacgttctcccctccgagacctgaaaggagctctggaaagtctgattgaagaggaaactgggcagaagaagatttaaatccattgggccagaaggaatgaccattactaacatgacttaagtataattctgacattgaaaatttataacccattaaatacctgtaaatggtatgaatttcagaaatccttacaccaagttgcacatattccataataaagtgctgtgttgtgaatg

SEQ ID NO: 138531 - DNA, 425 bp, Homo sapiens
  Payload ID: 7144
  Gene Symbol: GNRH2
  Gene Name: gonadotropin-releasing hormone 2
  Uniprot ID: O43555
  ENST ID: ENST00000245983
  CDS Start-End: 52-414
ctgcagctgcctgaaggagccatctcatccacagctcttccttgagcagccatggccagctccaggcgaggcctcctgctcctgctgctgctgactgcccaccttggaccctcagaggctcagcactggtcccatggctggtaccctggaggaaagcgagccctcagctcagcccaggatccccagaatgcccttaggcccccaggaagggccctggacactgcagcaggcagcccagtccagactgcccatggcctcccaagtgatgccctggctcccctggacgacagcatgccctgggagggcaggaccacggcccagtggtcccttcacaggaagcgacacctggcacggacactgctgaccgcagcccgagagccccgccccgccccgccatcctccaataaagtgtgaggttctccgaa

SEQ ID NO: 138532 - DNA, 404 bp, Homo sapiens
  Payload ID: 7144
  Gene Symbol: GNRH2
  Gene Name: gonadotropin-releasing hormone 2
  Uniprot ID: O43555
  ENST ID: ENST00000359100
  CDS Start-End: 52-393
ctgcagctgcctgaaggagccatctcatccacagctcttccttgagcagccatggccagctccaggcgaggcctcctgctcctgctgctgctgactgcccaccttggaccctcagaggctcagcactggtcccatggctggtaccctggaggaaagcgagccctcagctcagcccaggatccccagaatgcccttaggcccccagcaggcagcccagtccagactgcccatggcctcccaagtgatgccctggctcccctggacgacagcatgccctgggagggcaggaccacggcccagtggtcccttcacaggaagcgacacctggcacggacactgctgaccgcagcccgagagccccgccccgccccgccatcctccaataaagtgtgaggttctccgaa

SEQ ID NO: 138533 - DNA, 353 bp, Homo sapiens
  Payload ID: 7144
  Gene Symbol: GNRH2
  Gene Name: gonadotropin-releasing hormone 2
  Uniprot ID: O43555
  ENST ID: ENST00000380346
  CDS Start-End: 4-342
gccatggccagctccaggcgaggcctcctgctcctgctgctgctgactgcccaccttggaccctcagaggctcagcactggtcccatggctggtaccctggaggaaagcgagccctcagctcagcccaggatccccagaatgcccttaggcccccaggcagcccagtccagactgcccatggcctcccaagtgatgccctggctcccctggacgacagcatgccctgggagggcaggaccacggcccagtggtcccttcacaggaagcgacacctggcacggacactgctgaccgcagcccgagagccccgccccgccccgccatcctccaataaagtgtgaggttctccgaa

SEQ ID NO: 138534 - DNA, 758 bp, Homo sapiens
  Payload ID: 7144
  Gene Symbol: GNRH2
  Gene Name: gonadotropin-releasing hormone 2
  Uniprot ID: O43555
  ENST ID: ENST00000380347
  CDS Start-End: 406-747
gagaactcccctgaccatccatctatcctcccatccattggcctgaattcaggtctctgttcccctccaactttcttccacttctggaaactccttgaaggaaagatggatggacctggacaagtgggagggccctcagagctggcaaggcaggtagcctctgtgccccaggctcagggagaaggctcgtcccctggagcatcatcccctgctgggccaggatcccccaggatctggacccctgtatgcttgggatgaggagcggtggcagagagggaagggcataaggagataccaaagctgcccctgagatgccagttttccaaagtggccctggaggaagtagggggatgtgggggtgaggtaagtctccttgaatgctgtaccctgtccattagagcagccatggccagctccaggcgaggcctcctgctcctgctgctgctgactgcccaccttggaccctcagaggctcagcactggtcccatggctggtaccctggaggaaagcgagccctcagctcagcccaggatccccagaatgcccttaggcccccagcaggcagcccagtccagactgcccatggcctcccaagtgatgccctggctcccctggacgacagcatgccctgggagggcaggaccacggcccagtggtcccttcacaggaagcgacacctggcacggacactgctgaccgcagcccgagagccccgccccgccccgccatcctccaataaagtgtgaggttctccgaa

SEQ ID NO: 138535 - DNA, 2164 bp, Homo sapiens
  Payload ID: 7145
  Gene Symbol: GNRHR
  Gene Name: gonadotropin-releasing hormone receptor
  Uniprot ID: P30968
  ENST ID: ENST00000226413
  CDS Start-End: 26-1012
gcttgaagctctgtcctgggaaaatatggcaaacagtgcctctcctgaacagaatcaaaatcactgttcagccatcaacaacagcatcccactgatgcagggcaacctccccactctgaccttgtctggaaagatccgagtgacggttactttcttcctttttctgctctctgcgacctttaatgcttctttcttgttgaaacttcagaagtggacacagaagaaagagaaagggaaaaagctctcaagaatgaagctgctcttaaaacatctgaccttagccaacctgttggagactctgattgtcatgccactggatgggatgtggaacattacagtccaatggtatgctggagagttactctgcaaagttctcagttatctaaagcttttctccatgtatgccccagccttcatgatggtggtgatcagcctggaccgctccctggctatcacgaggcccctagctttgaaaagcaacagcaaagtcggacagtccatggttggcctggcctggatcctcagtagtgtctttgcaggaccacagttatacatcttcaggatgattcatctagcagacagctctggacagacaaaagttttctctcaatgtgtaacacactgcagtttttcacaatggtggcatcaagcattttataactttttcaccttcagctgcctcttcatcatccctcttttcatcatgctgatctgcaatgcaaaaatcatcttcaccctgacacgggtccttcatcaggacccccacgaactacaactgaatcagtccaagaacaatataccaagagcacggctgaagactctaaaaatgacggttgcatttgccacttcatttactgtctgctggactccctactatgtcctaggaatttggtattggtttgatcctgaaatgttaaacaggttgtcagacccagtaaatcacttcttctttctctttgcctttttaaacccatgctttgatccacttatctatggatatttttctctgtgattgatagactacacaagaagtcatatgaagaagggtaaggtaatgaatctctccatctgggaatgattaacacaaatgttggagcatgtttacatacaaacaaagtaggatttacacttaagttatcattcttttagaaactcagtcttcagagcctcaattattaaggaaaagtcttcaggaaaaatactaaaatattttctcttcctcataagcttctaaattaatctctgccttttctgacctcatataacacattatgtaggtttcttatcactttctctttgcataataatgtactaatatttaaaataccttcagcctaaggcacaaggatgccaaaaaaacaaaggtgagaaaccacaacacaggtctaaactcagcatgctttggtgagtttttctccaaaaggggcatattagcaattagagttgtatgctatataatacatagagcacagagccctttgcccataatatcaactttccctcctatagttaaaaagaaaaaaaatgaatctatttttctctttggcttcaaaagcattctgacatttggaggagtcagtaaccaatcccaccaaccactccagcaacctgacaagactatgagtagttctccttcatcctatttatgtggtacaggttgtgaagtatctctatataaagggaaattttagaggggttaggatttggacaggggtttagaacattcctctaagctatctagtctgtggagtttgtggcaattaattgccataaaataacaatgtttccaaatgcaactaagaaaatactcatagtgagtacgctctatgcatagtatgacttctattttaatgtgaagaattttttgtctctctcctgatcttactaaatccatatttcataaataactgagaataattaaaacaaaattaagcaaatgcacaagcaaaaagatgcttgatacacaaaaggaactctggagagaaaactacagcttcagtctgtacagatcaaagaagacagaacatgtcaggggaaggagggaaagatcttgatgcagggtttcttaacctgcagtctatgcacaacactatatttccatgtaatgtttttatttcagccctatttgtattattttgtgcatttaaaaaacacaatcttaagg

SEQ ID NO: 138536 - DNA, 859 bp, Homo sapiens
  Payload ID: 7145
  Gene Symbol: GNRHR
  Gene Name: gonadotropin-releasing hormone receptor
  Uniprot ID: P30968
  ENST ID: ENST00000420975
  CDS Start-End: 1-750
atggcaaacagtgcctctcctgaacagaatcaaaatcactgttcagccatcaacaacagcatcccactgatgcagggcaacctccccactctgaccttgtctggaaagatccgagtgacggttactttcttcctttttctgctctctgcgacctttaatgcttctttcttgttgaaacttcagaagtggacacagaagaaagagaaagggaaaaagctctcaagaatgaagctgctcttaaaacatctgaccttagccaacctgttggagactctgattgtcatgccactggatgggatgtggaacattacagtccaatggtatgctggagagttactctgcaaagttctcagttatctaaagcttttctccatgtatgccccagccttcatgatggtggtgatcagcctggaccgctccctggctatcacgaggcccctagctttgaaaagcaacagcaaagtcggacagtccatggttggcctggcctggatcctcagtagtgtctttgcaggaccacagctgcctcttcatcatccctcttttcatcatgctgatctgcaatgcaaaaatcatcttcaccctgacacgggtccttcatcaggacccccacgaactacaactgaatcagtccaagaacaatataccaagagcacggctgaagactctaaaaatgacggttgcatttgccacttcatttactgtctgctggactccctactatgtcctaggaatttggtattggtttgatcctgaaatgttaaacaggttgtcagacccagtaaatcacttcttctttctctttgcctttttaaacccatgctttgatccacttatctatggatatttttctctgtga

SEQ ID NO: 138537 - DNA, 1264 bp, Homo sapiens
  Payload ID: 7146
  Gene Symbol: GSC
  Gene Name: goosecoid homeobox
  Uniprot ID: P56915
  ENST ID: ENST00000238558
  CDS Start-End: 216-989
tcctacccgcgggttgagttcagcgaacgctgcggctaggggagggcgggaggagggagagcggacgcagggggcggggaggggcgcagggctgcgcgctcgccggcgctctctttcggtttggtcggcggctggaggagagtggacccccccactttaaggctctgtcctcggcgcgttcccgccgccccccggtcccgacgcggggctcggggatgcccgccagcatgttcagcatcgacaacatcctagccgcccggccgcgctgcaaggactcggtgttgccggtggcgcacagcgcggcggctcccgtcgtcttcccggccctgcacggggactcgctctacggcgccagcggcggcgcctcctcggactatggcgccttctacccgcgccccgtggcccccggcggcgcgggcctcccggccgcggtcagcggctcccgcctcggctacaacaactacttctacgggcagctgcacgtgcaggcggcgcccgtgggcccggcctgctgcggggccgtgccgccgctgggcgcccagcagtgctcctgcgtcccgacgcccccaggctacgagggccccggttcggtgctggtgtccccggtaccgcaccagatgctgccctacatgaacgtgggcacgctgtcgcgcaccgagctgcagcttctcaaccagctgcactgtcggcggaagcggcggcaccgcaccatcttcactgacgagcagctcgaagctctcgagaacctcttccaggagaccaagtacccggacgtgggcacgcgcgagcagctggcccggaaagtgcacctccgcgaggagaaagtggaggtctggtttaagaaccgccgcgccaaatggaggcggcagaagcggtcctcatcagaggagtcggagaacgcggagaagtggaacaagacgtcgtcgtcgaaggcgtcaccggagaagagggaagaggaaggtaaaagcgatttggactcggacagctgacggccgcgggacacttgcccgtattacttacctaactcgaaggacttgcacagacagacgatgctactttcttgcacacgcgctgccttgcgggagggggtcgagaaagaggaacgaggagctgtaaatagtgtacagagccgggagggtcggcgtctggggtcagggcgcgcacagcccagcagcccgaggccgcccgcgactagcccccaccgtagtatttatagttaaattaagggtgacagtacaataaagtgatggcgatgtagacgggc

SEQ ID NO: 138538 - DNA, 1033 bp, Homo sapiens
  Payload ID: 7147
  Gene Symbol: GSC2
  Gene Name: goosecoid homeobox 2
  Uniprot ID: O15499
  ENST ID: ENST00000086933
  CDS Start-End: 1-618
atggcggcagcggctgggggcgcggcgagccgccggggtgccgggcggccctgccccttctccatcgagcacatcctctccagcctgcccgagcggagcctcccggcccgggccgcctgcccaccgcagcccgccggtcgccagagccccgcgaagccagaggagcccggggcgcccgaggctgcgccctgcgcctgctgctgctgctgcggcccccgcgcggcgccctgcgggcccccagaggcggccgccgggctgggcgctcgtctggcgtggccgctgaggctgggaccggcggtgcccttgtctctgggtgcgccagccggaggttccggggcgctcccgggcgcggtcggcccgggttcgcagcggcgcacgaggcgccaccgcaccatcttcagcgaagagcagctgcaggcgctcgaggcgcttttcgtgcagaaccagtatcctgacgtgagtacgcgcgagcgcctggccggccgcatccgccttcgcgaggagcgcgtggaggtctggttcaagaaccgccgggccaaatggcgacaccagaagcgcgcgtcggcttccgcgaggctcctgcccggcgtcaagaagtccccgaaggggagctgctgatgactctaggagctgcccctgggctcggccaccctttttgggatctttggagttggcgctgagagaagacaggtctacccgaaaaggagctgggagagtacaccggccgcctccacccgtctccacagcccttgcctcctgcagctcgtgctgccgtggcgctggggacgggcccccggtgcttggtgttccacggcagtgggagtggcgagtcccttgggggtgggctggggcatagagcagtttcctcagctccctaccccccgagagacactaactccaccgcaggaggggaaccaccccgtatcaacacgggacccagaatcctacgcagtggagcgtctctccgcaccctgggacatgctggccaccctcttctcaatgtggacattgacctaacttgacctggctcgtc

SEQ ID NO: 138539 - DNA, 5368 bp, Homo sapiens
  Payload ID: 7148
  Gene Symbol: GPALPP1
  Gene Name: GPALPP motifs containing 1
  Uniprot ID: Q8IXQ4
  ENST ID: ENST00000357537
  CDS Start-End: 422-934
tttttttgagatgaagtctcactctgtagcccagactggaatccggtggcacgatctcagctcactgtagcctctgcctcctaagttcaagtggttctcctgtctcagtctcccaagtagctggaactacagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggaaacagacagcagtgaagatgaggatattattggaccaatgcctgcaaaaggaccagttaactataatgtaacgacagagtttgaaaaaagggcccagagaatgaaagaaaaactgaccaaaggagatgatgattcatctaaacccattgtaagagagtcatggatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataatgataggtattattagaaaaaagttatttcttgagttacacctaagaggaagaagtaacatgatggaaagtggttggagatagcacccaattaacatcgacagccaagtcttctatttcagaatattgatttatttcgctttggcttttgatgccatcatgagatttaagtctgcagtttcaaaagctcatgctacttagatgatttttgcagcttaaaaaattgcttgtgactgcagtatgtacacagttaaaaagctgttcactgcccctttcaaccttttcattttgagctttactaagagaatgcttttaggaacagaattcctaaagtgtaattttttatgtataaataaagttttatctatatctgagaagttgtagtatttatttttgttttaacattattagcttttctgaagcaggcagtattggtaaagagaatattctgtaaaggtttattccggccaaccagatcattgtaggctattgtaaaaaacaacaacaactttaactccaactcgcttgccaggttttcattatctaatataactatacagatattatctgtttatttagaaacacaagacagacaaactggaaatgttcttgagagcactgtgacactgggttataaccaagattccattgttcttcatatcacaggacctgtaacagtgggtaggttttttctggattgtttgagtatgagtttctttggtttggtttggtttggtctctctaactcccaaattgaaagtgaccaaaagagatgctttgcaacatcaaagctaagcattgaatgataggaatctgaacatgtagggtcaaaaagagagcctttgctttctcagatcatttccctataataagtatttctggaggaacttatatgtttgttcatttattcaataaacatttattaaatgcctcagtgtatgctaggtgctaagaacacaatggtgaaccaggcaggcatagtcttcctccctgggagaagattctgtgctggtcccttatagggtattcacagataagtaaagcagattccttgatttgtgattttatattctagtgggagagcagaaaaagatctgagtaaaaaagatcaagtaattgcacattgttgataggtgttagaaagaaaacacggtagtgaaagactagaacaagtagttgaggatgggaattctatctagttagagtgataagaagtctctgaagatgtgtcatttaagctgaaacctaaaaaaatgaaaagctagcagtgtgaaaagtgactgatcacatatgcaaatgccctgaagctttagttctttggtgtttgaggaactgctccagtatggcgggtatattgtgagaaatatgatggttcagggttgggtcttcatagtgtctactgatactatgaagcctatataggaacatctaacccagtcctgggaggtgaaaggaagcttcctaatggagaatacttttttatttttatttctttttttttttttttattttttttttttgagacagagtctccctctgtcgcccagactggagtgtaatggcgcaatctcggctcactgcaccctccgccttccaggttcaagtgattctcctgcctcagcctcctgatagctgggattacaggcacccgccaccacacccggctgatttctgtatttttagtagagacagggtttcgccatgttggccaggctggtctttttttttttttttttttttgagacggagtctggctctgtctctcaggctggagtgcagtggcgccatctcggctcactgcaagctccgcctctcgggttcacgccattctcctgcctcagcctccccagtagctgggactacaggcgcccaccaccacgcccggctaattttttgtattattagtagagacggggtttcaccgtgttagccaggatggtctcgatctcctgacctgttgatccatccgccttggcctcccaaagtgctgggattacaggcgtgagccaccgcccccggcctccaatggagaatacttcttaaccaagttataaacatgacattggagttggccagatggttcttacaccaaaggtctactctgctggccttccagaattgcccaaatgtgtctgaattcactcttaggcccttgctctgcaaacaccctgtatgtaactccactaataactgtcattagttatcagaacattaatacattgatctgaacattgagcctatactttatcatcaaaaccataaatatttaagaatagctgtttttttaagaagttgttgtaaattacttgtttcctcctgggcctaattattgagggttatttacattctttttaagaactgaatagcaccagatgaattcaacaattattagtcaagtctctagaattctggacatagcagaatgtttttacttagggactgaaaaatacagtagatcagtctgtctcttaatttgtaatccttaaactatttctatcagaatcacctaggagttcatttaaatgcagatctccaggcccaaacctattgaataggaatctttggggttagaatcagagcatcttcacttttaacaattatcccaggccattctttgtaaattcaagtttaagaaccactgcatttatgggcagacaaggtagctcacacctgtaatctcagcactttggagggccaaggtgggaggattgcttgaggccaggagttcaaggctaccctggccaacatggtgaaaccctgactctaaaaagaaatttaaaaaaataataaccaccgcacttacatgtgttcctataaacaatcccctctcctttgttatatgttctgttttcctattatatattcctaaatacataatcactttactttgcatagcaacaaacaccagcaccagcaatacttgcctcttgaagaatggattgtcacttctcttgagtgaatgcctaaaagcattcacccttcaaacatctaccagccagttgctacagtgatcaagattctactgccattgataattcagtttcattgcactttgccctctcttcagcaccttttaaaatagataagtccctaagaggaatagtcagattgtagttccttgtccctggctgacttggggccatttaagactgaatgcctcaggaatgcagaacattgaaaaggcagggagcacaaaaagggagcactggtgggctatagatgatctgcaaaggatggtctctaccttatgactattttccttgggggaattaaccagttaatgttactttgaggtcttagataactgtgctttggcagctaaggtattaacttcagaagcaactgagtttacttttagataccagtttctgtatttgctgacaaagaaaagataacagtaggtaaaagaatgttaaaaagaaacaaaaggccaggcacaatgcctcacatctgtaatcccagcacttcaagaggccaagacaggaggatcacttgagggccaggagttcaagaccaacctgggcaacgtggcatgaccctgtctctacaaaaaaataaaaattaaaaattatctgggcatggtggcatggcatgcatctgtagtcccagctactcaggaagctaaggcaggaggatcacttgagcccaagagttcaaggctgcagtgagctatgaacatgccactgcactccagccagggagacagagagaccccatctctaaaagagaaaaaaagaaagcaataaaattctgcagaactaggtaggaaagacaataaaagctacaagggtgcatcattgttttgagatctagacaaatttcgagaacctattcaagaatattgaaaagtatttcaaagttcattttcatatctctgattacttaccgctgtcctgccctttaaagcacttccatttgttttctttatgatggggtaatgttggccaaacaggctatatgataaagtatttagtcctagttttatcttcatacaatcagagctctgagatgaaaataaacttgttccttttttatcactaggtacaaaacaacaaatgaagttgcttatgtatataatatgatgatttttgtctttttaggtaatggctgaaagcaacacattttgctaacctaaggataaataatactataatacctaattcacactacacacttaacaaaagcaatttatcatcagcctaagattgctaatttttataacaggtacagacataattaacttaatattgaccagcaaataaatctagaaattgtgcttattctttagtattcattttaactgaatttaaattagtgtttttccctaacagccttgtatattgcttaataaaattgtcatatttgaaaacagagattcttaaagtttaaaatgcttgcagtcaaatgacagtttatcaataaagatttaaaacta

SEQ ID NO: 138540 - DNA, 3410 bp, Homo sapiens
  Payload ID: 7148
  Gene Symbol: GPALPP1
  Gene Name: GPALPP motifs containing 1
  ENST ID: ENST00000361121
  CDS Start-End: 92-1108
ccattcttcgctgctgatcgcgggattctttttggatagggttgacgttcgtggatagactcatatctgtgaccagtgtccgccaccgcggatggcaagagacctgatcggaccggccctgccgcccggcttcaaggcccgcggaacagcggaggacgaagagcgggacccgagccctggaccagctctgccccctaattataaaagcagtagttcagattcatcagacagcgatgaagacagtagttctttgtacgaagaaggaaatcaagaatctgaagaagatgacagtggtccaactgcaagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggaaacagacagcagtgaagatgaggatattattggaccaatgcctgcaaaaggaccagttaactataatgtaacgacagagtttgaaaaaagggcccagagaatgaaagaaaaactgaccaaaggagatgatgattcatctaaacccattgtaagagagtcatggatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataagtaagtatatttcagtgaggtatattttaatactgatcaatgtgaacttttctaaatactctattgtctttaataattgtgctgaaatctatttccttttataatagattaaaaattttatatttttataagtaaacagtgatttttgaaaagtcagccttgtgggatgaaaaatatgtcttactggaaaaatccctcataataacctaatagggcattgctattaaaaatgctaaaataaaaattcagcttatgagaaatggcaaaggaaggtgtggtttgatacttgagtaaatatgcatgctttattaaagatgaagaaaggcttgctggttgtttgtatgttaaacaaaatcccaactaggaaatgtttgttgcttagaaaggtcccctataagttaaggttcaaaactattccaatattcatccatagcccaatctgacaagggttcagaatggtgattaagaaattacataaagctgggtgcagtggctcacgcctgtaatcccaacactttgggaggccaatgtgagaggatcgcttgagcccagtagtttgagaccagcctgcttaagatggtgagaccccgtatctacaaaaaactaaccaggtgcagtggagcacacctatagtcccagctactcagcaggctgaggtgggaggatcccttgagcccaggaattcaaggcagcagtgagctgtgattgtgccattgcactccagtctgggcaacaaagtgagacctcgtctctttagaaaaaaaaaaagaggccagtggctcacacctgtaatcccagcactttgggagggtgaggcgggtggatcacctgaggtcaggagttcgagaccagcctgaacaacatggtgaaaccccatctctattaaaaatatatatatataaaaattagccaggtgtggtggcacgtgcctgtaatctcagctacttgggagcctgaggcaggagaattgcttgaacccgggaggtggaggttacagtgagccgagatcgtgccactgcactctagcctaggtgacaagatcgagagactctgtctcaaaaaagaaagaaaaagagaagaaaagaaattacataaaagctgaggttgcttcttaatatctttatgatttttaattgtattaaacctatatcaatattcaaatgtgatttttgaggaaaatatgttaaatttagaaatattttccaacttactgagttttcttattcttacctcagggggatttccctgtgcaatgaagaaaagttgaagaatactctttgtccatctttatttctttgtttttggcttcttaagattagagattactttaatcttaaaaaacatacaaatttaccttgttctgtatgtccttttaaggtcatgtggaaacataaaacgaatgttttttatgtagaacagaatattctatgtgcctttagcttctgtggaagtatggggaattatgggcttttcttcaaataattattttaagaggcttccattccccctgatttttgtggtgtctcacaagtaccctctaaggtctggtcaggactgaccaccaaatctctaccacagcctggacctccttgtgaaatatacctaacctgccctagagtcagtgtgtcaagtccttactgtaaatccatgactttgaaatttgttgttttttccctttaaactgcagccagtgaatacaaatttacttgaaaatagagggtatggggttttgcctgttttgtaatcagtttgcttgttttagcactcagggctttttatttgttatttaattttttaattgtttttaagtcagaaagatctctgggttatctcatgtgctaaggaaaaactattttgctttttccaactttaatagttagtatttctaggggaggcaatcaagataagatatgccattaactgttagcattgtgaaatctgtaagactcaatctctgatctcaaccaaagctttctgagtcctggaactttgctttgggacaactttactttacccatttatatgctgtacttaacagtttgtagctaatttatggggtcatatcttttttttagctaatttacgggggtcatatcagtcatgaatagccttttttaaaaatttaataatccctgaatacaaaaatggaaatggaaaatttataatcataacccccctaattgggagtattataagtttgtaatgctttaagcactgcctcttaagatgataaatttataagatgagaaattctatttaaactattaaactattgttaaataaatgccaattctataagtta

SEQ ID NO: 138541 - DNA, 1393 bp, Homo sapiens
  Payload ID: 7148
  Gene Symbol: GPALPP1
  Gene Name: GPALPP motifs containing 1
  Uniprot ID: Q8IXQ4
  ENST ID: ENST00000379151
  CDS Start-End: 104-1126
ccgggaaacctgccattcttcgctgctgatcgcgggattctttttggatagggttgacgttcgtggatagactcatatctgtgaccagtgtccgccaccgcggatggcaagagacctgatcggaccggccctgccgcccggcttcaaggcccgcggaacagcggaggacgaagagcgggacccgagccctgttgcaggaccagctctgccccctaattataaaagcagtagttcagattcatcagacagcgatgaagacagtagttctttgtacgaagaaggaaatcaagaatctgaagaagatgacagtggtccaactgcaagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggaaacagacagcagtgaagatgaggatattattggaccaatgcctgcaaaaggaccagttaactataatgtaacgacagagtttgaaaaaagggcccagagaatgaaagaaaaactgaccaaaggagatgatgattcatctaaacccattgtaagagagtcatggatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataagtaagtatatttcagtgaggtatattttaatactgatcaatgtgaacttttctaaatactctattgtctttaataattgtgctgaaatctatttccttttataatagattaaaaattttatatttttataagtaaacagtgatttttgaaaagtcagccttgtgggatgaaaaatatgtcttactggaaaaatccctcataataacctaatagggcattgctattaaaaatgctaaaataaaaattcagcttatgagaaatggcaaa
